(12) United States Patent
Toporik et al.

(10) Patent No.: US 7,528,243 B2
(45) Date of Patent: May 5, 2009

(54) NUCLEOTIDE AND AMINO ACID SEQUENCES, AND ASSAYS AND METHODS OF USE THEREOF FOR DIAGNOSIS OF BREAST CANCER

(75) Inventors: Amir Toporik, Azur (IL); Dvir Dahary, Tel-Aviv (IL); Rotem Sorek, Rechovot (IL); Sarah Pollock, Tel-Aviv (IL); Zurit Levine, Herzlia (IL); Pinchas Akiva, Ramat-Gan (IL); Alexander Diber, Richon-LeZion (IL); Amit Novik, Beit-Ha-Sharon (IL); Osnat Sella-Tavor, Kfar Kish (IL); Michal Ayalon-Soffer, Ramat-HaSharon (IL); Shira Walach, Hod-HaSharon (IL); Shirley Sameah-Greenwald, Kfar-Saba (IL); Ronen Shemesh, Modiln (IL); Naomi Keren, Givat Shmuel (IL); Maxim Shklar, Tel-Aviv (IL)

(73) Assignee: Compugen Ltd, Tel Aviv (IL)

( * ) Notice: Subject to any disclaimer, the term of this patent is extended or adjusted under 35 U.S.C. 154(b) by 0 days.

(21) Appl. No.: 11/711,827

(22) Filed: Feb. 28, 2007

(65) Prior Publication Data

US 2007/0259386 A1 Nov. 8, 2007

(51) Int. Cl.
*C07H 21/02* (2006.01)
*C07H 21/04* (2006.01)
(52) U.S. Cl. .................................. 536/23.1; 536/24.33
(58) Field of Classification Search ................ 536/23.1, 536/24.33
See application file for complete search history.

(56) References Cited

FOREIGN PATENT DOCUMENTS

WO WO 03/105758 A2 12/2003

OTHER PUBLICATIONS

Tockman et al (Cancer Res., 1992, 52:2711s-2718s).*
The 1997/1998 Stratagene catalog (p. 118, 1997/1998).
Tockman et al (Canacer Res., 1992, 52:2711s-2718s).
Obermair et al (International Journal of Cancer, 2002, 100:166-171).
Affymetrix, "GeneChip® Human Genome Arrays", 4 pages, 2008.
Affymetrix, "Human Genome U133 Plus 2.0 Array", http://www.affymetrix.com/products/arrays/specific/hgu133plus.affx, 2 pages, 2008.
Affymetrix, "Human Genome U133 Set", http://www.affymetrix.com/products/arrays/specific/hgu133.affx 1 page, 2008.
Affymetrix, "Human Genome U133A 2.0 Array", http://www.affymetrix.com/products/arrays/specific/Hgu133av2.affx, 2 pages, 2008.
Barrett et al., "NCBI GEO: mining millions of expression profiles—database and tools", *Nucl. Acids Res.*, 33:D562-D566 (2005).
Boguski et al., "dbEST—database for 'expressed sequence tags'", *Nat. Genet.*, 4:332-333 (1993).
CBS, "Instructions", http://www.cbs.dtu.dk/services/TMHMM/TMHMM2.0b.guide.php, 3 pages, Oct. 29, 2003.
CBS, "Scientific Background", http://www.cbs.dtu.dk/services/SignalP/background/prediction.php, 2 pages, May 6, 2004.
Ch.EMBnet.org, "TMpred—Prediction of Transmembrane Regions and Orientation", http://www.ch.embnet.org/software/TMPRED_form.html, 1 page, 2008.
Edgar et al., "Gene Expression Omnibus: NCBI gene expression and hybridization array data repository", *Nucl. Acids Res.*, 30(1):207-210 (2002).
Fahrlander et al., "Amplifying DNA Probe Signals: A 'Christmas Tree' Approach", *Biotechnology*, 6:1165-1168 (1988).
Hazkani-Covo et al., "Evolution of multicellularity in Metazoa: comparative analysis of the subcellular localization of proteins in Saccharomyces, Drosophila and Caenorhabditis", *Cell Biol. Int'l*, 28:171-178 (2004).
Hofmann et al., "A database of Membrane Spanning Protein Segments", *Biol. Chem.*, Abstract MF C-35, 374:166 (1993).
Krogh et al., "Predicting Transmembrane Protein Topology with a Hidden Markov Model: Application to Complete Genomes", *J. Mol. Biol.*, 305:567-580 (2001).
NCBI, "Expressed Sequence Tags database", http://www.ncbi.nlm.nih.gov/dbEST/, 2 pages, Jul. 11, 2000.
NCBI, "Genbank Overview", http://www.ncbi.nlm.nih.gov/Genbank/GenbankOverview.html, 2 pages, Sep. 20, 2004.
NCBI, "Gene Expression Omnibus", http://www.ncbi.nlm.nih.gov/projects/geo/, 1 page, 2008.
NCBI, "Geo Overview", http://www.ncbi.nlm.nih.gov/projects/geo/info/overview.html, 3 pages, 2008.
NCBI, "tissue-specific pattern of mRNA expression", http://www.ncbi.nlm.nih.gov/geo/query/acc.cgi?acc=GSE1133, 2 pages, Mar. 19, 2004.
Sorek et al., "A novel algorithm for computational identification of contaminated EST libraries", *Nucl. Acids Res.*, 31(3):1067-1074 (2003).
Sorek et al., "*Alu*-Containing Exons are Alternatively Spliced", *Genome Res.*, 12:1060-1067 (2002).
Su et al., "A gene atlas of the mouse and human protein-encoding transcriptomes", *PNAS*, 101(16):6062-6067 (2004).

* cited by examiner

*Primary Examiner*—Sean E Aeder
(74) *Attorney, Agent, or Firm*—Ivor R. Elrifi; David E. Johnson; Mintz, Levin, Cohn, Ferris, Glovsky and Popeo PC

(57) ABSTRACT

Novel markers for breast cancer that are both sensitive and accurate. These markers are overexpressed in breast cancer specifically, as opposed to normal breast tissue. The measurement of these markers, alone or in combination, in patient samples provides information that the diagnostician can correlate with a probable diagnosis of breast cancer. The markers of the present invention, alone or in combination, show a high degree of differential detection between breast cancer and non-cancerous states.

5 Claims, 43 Drawing Sheets

NUCLEOTIDE AND AMINO ACID SEQUENCES, AND ASSAYS AND METHODS OF USE THEREOF FOR DIAGNOSIS OF BREAST CANCER

CROSS-REFERENCE TO RELATED APPLICATION(S)

THIS APPLICATION IS RELATED TO NOVEL NUCLEOTIDE AND AMINO ACID SEQUENCES, AND ASSAYS AND METHODS OF USE THEREOF FOR DIAGNOSIS OF BREAST CANCER, AND CLAIMS PRIORITY TO AND INCORPORATES HEREIN BY REFERENCE (IN THEIR ENTIRETY) EACH OF THE CORRESPONDING NON-U.S. PROVISIONAL APPLICATIONS AND THEIR CORRESPONDING U.S. PROVISIONAL APPLICATIONS NOTED BELOW:

NON-PROVISIONAL Application Ser. No. 11/043,842 FILED ON Jan. 27, 2005 AND 60/620,916 FILED Oct. 22, 2004—DIFFERENTIAL EXPRESSION OF MARKERS IN COLON CANCER APPLICATION No. 60/628,123 FILED Nov. 17, 2004—DIFFERENTIAL EXPRESSION OF MARKERS IN COLON CANCER II APPLICATION No. 60/621,131 FILED Oct. 25, 2004—DIAGNOSTIC MARKERS FOR COLON CANCER, AND ASSAYS AND METHODS OF USE THEREOF APPLICATION No. 60/620,917 FILED Oct. 22, 2004—DIFFERENTIAL EXPRESSION OF MARKERS IN BREAST CANCER APPLICATION No. 60/628,101 FILED Nov. 17, 2004—DIFFERENTIAL EXPRESSION OF MARKERS IN BREAST CANCER II APPLICATION No. 60/620,874 FILED Oct. 22, 2004—DIFFERENTIAL EXPRESSION OF MARKERS IN OVARIAN CANCER APPLICATION No. 60/628,134 FILED Nov. 17, 2004—DIFFERENTIAL EXPRESSION OF MARKERS IN OVARIAN CANCER II APPLICATION No. 60/620,924 FILED Oct. 22, 2004—DIFFERENTIAL EXPRESSION OF MARKERS IN STOMACH CANCER APPLICATION No. 60/628,111 FILED Nov. 17, 2004—DIFFERENTIAL EXPRESSION OF MARKERS IN STOMACH CANCER II APPLICATION No. 60/620,853 FILED Oct. 22, 2004-28814—DIFFERENTIAL EXPRESSION OF MARKERS IN LUNG CANCER APPLICATION No. 60/628,112 FILED Nov. 17, 2004—DIFFERENTIAL EXPRESSION OF MARKERS IN LUNG CANCER II APPLICATION No. 60/620,974 FILED Oct. 22, 2004—DIFFERENTIAL EXPRESSION OF MARKERS IN PANCREATIC CANCER APPLICATION No. 60/628,145 FILED Nov. 17, 2004—DIFFERENTIAL EXPRESSION OF MARKERS IN PANCREATIC CANCER II APPLICATION No. 60/620,656 FILED Oct. 22, 2004—DIFFERENTIAL EXPRESSION OF MARKERS IN PROSTATE CANCER APPLICATION No. 60/628,251 FILED Nov. 17, 2004—DIFFERENTIAL EXPRESSION OF MARKERS IN PROSTATE CANCER II APPLICATION No. 60/620,975 FILED Oct. 22, 2004—DIFFERENTIAL EXPRESSION OF MARKERS IN BRAIN CANCER APPLICATION No. 60/628,178 FILED Nov. 17, 2004—DIFFERENTIAL EXPRESSION OF MARKERS IN BRAIN CANCER II APPLICATION No. 60/628,231 FILED Nov. 17, 2004—NOVEL DIAGNOSTIC SERUM MARKERS, AND ASSAYS AND METHODS OF USE THEREOF APPLICATION No. 60/620,918 FILED Oct. 22, 2004—DIAGNOSTIC MARKERS FOR RENAL CANCER, AND ASSAYS AND METHODS OF USE THEREOF APPLICATION No. 60/628,156 FILED Nov. 17, 2004—DIAGNOSTIC MARKERS FOR RENAL CANCER, AND ASSAYS AND METHODS OF USE THEREOF II APPLICATION No. 60/628,167 FILED Nov. 17, 2004—DIFFERENTIAL EXPRESSION OF MARKERS IN BLADDER CANCER II APPLICATION No. 60/621,004 FILED Oct. 22, 2004—DIFFERENTIAL EXPRESSION OF MARKERS IN SKIN AND EPITHELIAL CANCER II APPLICATION No. 60/628,179 FILED Nov. 17, 2004—NOVEL DIAGNOSTIC MARKERS, AND ASSAYS AND METHODS OF USE THEREOF APPLICATION No. 60/539,129 FILED Jan. 27, 2004—METHODS AND SYSTEMS FOR ANNOTATING BIOMOLECULAR SEQUENCES APPLICATION No. 60/539,128 FILED Jan. 27, 2004—EVOLUTIONARY CONSERVED SPLICED SEQUENCES AND METHODS AND SYSTEMS FOR IDENTIFYING THEREOF AND Application Ser. No. 11/043,842 FILED Jan. 27, 2005

FIELD OF THE INVENTION

The present invention is related to novel nucleotide and protein sequences that are diagnostic markers for breast cancer, and assays and methods of use thereof. The "Sequence Listing" recited on the computer readable form (CFR) CD filed herewith is incorporated herein by reference in its entirety.

BACKGROUND OF THE INVENTION

Breast cancer is the most commonly occurring cancer in women, comprising almost a third of all malignancies in females. It is the leading cause of death for women between the ages 40-55 in the United States and one out of 8 females in the United States will develop breast cancer at some point in her life.

The death rate from breast cancer has been slowly declining over the past decade, partially due do the usage of molecular markers that facilitate the discovery, tumor typing (and therefore choice of treatment), response to treatment and recurrence.

The most widely used serum markers for breast cancers are Mucin1 (measured as CA 15-3) and CEA (CarcinoEmbryonic Antigen). Mucin 1 (MUC1) is present on the apical surface of normal epithelial cells. Its extracellular domain consists of a heavily O-linked glycosylated peptide core made up of variable number of multiple repeats of 20 amino acid sequence referred to as VNTR (Variable Number Tandem Repeat). This variability results in natural polymorphism of MUC1. Each VNTR has five potential O-linkage sites. The breast cancer disease state alters the enzymes which glycosylate Mucin 1 and therefore the polysaccharide side chains of tumor associated MUC1 are generally shorter than those on the normally expressed molecule. Both aberrant and up-regulated expression of MUC1 are features of malignancy and MUC1 related markers are based on it. Though CA 15-3 is a broadly used marker for breast cancer, a combination of CA 15-3 and CEA is more sensitive than using a single marker.

For the purpose of monitoring therapeutic response, CA 15-3, CEA and ESR (Erythrocyte Sedimentation Rate) are used as a panel, leading to over 90% of patients biochemically assessable. Serum markers used to monitor therapeutic response in patients with metastatic breast cancer are associated with the "spike phenomenon". It is an initial transient rise of tumor marker levels which can be seen in up to 30% of responders in the first 3 months of commencing a therapy. It is important not to interpret this as a sign of disease progression leading to premature change of an effective therapy.

CA 27.29 is a new monoclonal antibody directed against a different part of MUC1 and it is a newer marker than CA 15-3. It detects a different glycosylation pattern of MUC1, as compared with CA 15-3. CA 27.29 is the first FDA-approved blood test for breast cancer recurrence. Because of superior sensitivity and specificity, CA 27.29 has supplanted CA 15-3 as the preferred tumor marker in breast cancer. The CA 27.29 level is elevated in approximately one third of women with early-stage breast cancer (stage I or II) and in two thirds of women with late-stage disease (stage III or IV). CA 27.29 lacks predictive value in the earliest stages of breast cancer and thus has no role in screening for or diagnosing the malignancy. CA 27.29 also can be found in patients with benign disorders of the breast, liver, and kidney, and in patients with ovarian cysts. However, CA 27.29 levels higher than 100 units per mL are rare in benign conditions.

Recently Estrogen 2 (beta) was shown to have a diagnostic role in breast cancer. It has been shown that the expression of the 'cx' variant of Estrogen 2 is correlated with response to Hormone adjuvant therapy. In addition it has been shown it may assist in better characterization of ER-1 positive breast cancers (together with progesterone receptor).

HER-2 (also known as c-erbB2) is a membrane proto-oncogene with intrinsic tyrosine kinase activity. Tumor expressing HER-2 are associated with shorter survival, shorter time-to-relapse and an overall worse prognosis. Tumors expressing HER-2 can be targeted with Trastuzumab—a biological adjuvant therapy which blocks the growth promoting action of HER-2. The ImmunoHistoChemistry (IHC) and Fluorescence In Situ Hybridization (FISH) tests are used to detect HER2: 1.IHC: The most common test used to check HER2 status is an ImmunoHistoChemistry (IHC) test. The IHC test measures the protein made by the HER2 gene. 2.FISH: This test measures the number of copies of the HER2 gene present in the tumor cell.

Measurement of the extracellular domain of HER-2 has been reported to show a better assessment of response to chemotherapy than a biochemical index score based on measurement of CA 15.3, CEA and ESR in a small series of patient. That finding is yet to be confirmed in a larger group of patient with HER-2 expressing tumors.

Other molecular markers, mainly used for the diagnosis for cancers other than breast cancer were shown to have a diagnostic potential in breast cancer. For example, CA125 which is a major marker for ovarian cancer is also associated with breast cancer. High levels of CA 19-9, a major marker for colorectal and pancreatic cancers, can be found in breast cancer. Overall, these markers are not frequently used for the detection of breast cancer to due their inferiority compared with other markers already described.

Panels of markers for the diagnosis and typing of breast cancer are being used by pathologists, including both markers described above and additional markers, such as immunohistochemistry markers that have been shown to have a beneficial value for the diagnosis of breast cancer, including PCNA and Ki-67 are maybe the most important and highly used immunohistochemistry markers for breast cancer. Other markers as E-Cadherin, Cathepsin D and TFF1 are also used for that purpose.

Despite relevant research efforts and the identification of many putative good prognosticators, few of them are proving clinically useful for identifying patients at minimal risk of relapse, patients with a worse prognosis, or patients likely to benefit from specific treatments. Most of them, such as epidermal growth factor receptor, cyclin E, p53 (this mutation is present in approximately 40% of human breast cancers as an acquired defect), bcl-2, vascular endothelial growth factor, urokinase-type plasminogen activator-1 and the anti-apoptosis protein survivin, are suggested for possible inclusion in the category of biomarkers with a high level of clinico-laboratory effectiveness. However, no single biomarker was able to identify those patients with the best (or worst) prognosis or those patients who would be responsive to a given therapy. High level cyclin E expression has been associated with the initiation or progression of different human cancers, in particular breast cancer but also leukemia, lymphoma and others. Cyclin-E expression level in the breast cancer was found to be a very strong indicator for prognosis, stronger than any other biological marker.

There are some non-cancerous pathological conditions which represent an increased risk factor for development breast cancer. Non-limiting examples of these conditions include:

Ductal hyperplasia without atypia. It is the most frequently encountered breast biopsy result that is associated with increased risk of future development of breast cancer (2 fold increased risk). In particular, the loss of expression of transforming growth factor beta receptor II in the affected epithelial cells is associated with an increased risk of invasive breast cancer.

Atypical hyperplasia. Women having atypical hyperplasia with over-expression of HER-2 have a greater than 7-fold increased risk of developing invasive breast carcinoma, as compared with women with non-proliferative benign breast lesions and no evidence of HER-2 amplification.

These pathological conditions should be effectively diagnosed and monitored in order to facilitate early detection of breast cancer.

SUMMARY OF THE INVENTION

The background art does not teach or suggest markers for breast cancer that are sufficiently sensitive and/or accurate, alone or in combination.

The present invention overcomes these deficiencies of the background art by providing novel markers for breast cancer that are both sensitive and accurate. These markers are over-expressed in breast cancer specifically, as opposed to normal breast tissue. The measurement of these markers, alone or in combination, in patient (biological) samples provides information that the diagnostician can correlate with a probable diagnosis of breast cancer. The markers of the present invention, alone or in combination, show a high degree of differential detection between breast cancer and non-cancerous states.

According to preferred embodiments of the present invention, examples of suitable biological samples which may optionally be used with preferred embodiments of the present invention include but are not limited to blood, serum, plasma, blood cells, urine, sputum, saliva, stool, spinal fluid or CSF, lymph fluid, the external secretions of the skin, respiratory, intestinal, and genitourinary tracts, tears, milk, neuronal tissue, breast tissue, any human organ or tissue, including any tumor or normal tissue, any sample obtained by lavage (for example of the bronchial system or of the breast ductal system), and also samples of in vivo cell culture constituents. In a preferred embodiment, the biological sample comprises breast tissue and/or a serum sample and/or a urine sample and/or a milk sample and/or any other tissue or liquid sample. The sample can optionally be diluted with a suitable eluant before contacting the sample to an antibody and/or performing any other diagnostic assay.

Information given in the text with regard to cellular localization was determined according to four different software programs: (i) tmhmm (from Center for Biological Sequence Analysis, Technical University of Denmark DTU, cbs.dtu.dk/services /TMHMM/TMHMM2.0b.guide.php) or (ii) tmpred (from EMBnet, maintained by the ISREC Bionformatics group and the LICR Information Technology Office, Ludwig Institute for Cancer Research, Swiss Institute of Bioinformatics, ch.embnet.org/software/TMPRED_form.html) for trans-membrane region prediction; (iii) signalp_hmm or (iv) signalp_nn (both from Center for Biological Sequence Analysis, Technical University of Denmark DTU, cbs.dtu.dk/services/SignalP/background/prediction.php) for signal peptide prediction. The terms "signalp_hmm" and "signalp_nn" refer to two modes of operation for the program SignalP: hmm refers to Hidden Markov Model, while nn refers to neural networks. Localization was also determined through manual inspection of known protein localization and/or gene structure, and the use of heuristics by the individual inventor. In some cases for the manual inspection of cellular localization prediction inventors used the ProLoc computational platform [Einat Hazkani-Covo, Erez Levanon, Galit Rotman, Dan Graur and Amit Novik; (2004) "Evolution of multicellularity in metazoa: comparative analysis of the subcellular localization of proteins in *Saccharomyces, Drosophila* and *Caenorhabditis*." Cell Biology International 2004:28(3):171-8.], which predicts protein localization based on various parameters including, protein domains (e.g., prediction of trans-membranous regions and localization thereof within the protein), pI, protein length, amino acid composition, homology to pre-annotated proteins, recognition of sequence patterns which direct the protein to a certain organelle (such as, nuclear localization signal, NLS, mitochondria localization signal), signal peptide and anchor modeling and using unique domains from Pfam that are specific to a single compartment.

Information is given in the text with regard to SNPs (single nucleotide polymorphisms). A description of the abbreviations is as follows "T.fwdarw.C", for example, means that the SNP results in a change at the position given in the table from T to C. Similarly. "M.fwdarw.Q", for example, means that the SNP has caused a change in the corresponding amino acid sequence, from methionine (M) to glutamine (Q). If, in place of a letter at the right hand side for the nucleotide sequence SNP, there is a space, it indicates that a frameshift has occurred. A frameshift may also be indicated with a hyphen (-). A stop codon is indicated with an asterisk at the right hand side (*). As part of the description of an SNP, a comment may be found in parentheses after the above description of the SNP itself. This comment may include an FTId, which is an identifier to a SwissProt entry that was created with the indicated SNP. An FTId is a unique and stable feature identifier, which allows construction of links directly from position-specific annotation in the feature table to specialized protein-related databases. The FTId is always the last component of a feature in the description field, as follows: FTId=XXX_number, in which XXX is the 3-letter code for the specific feature key, separated by an underscore from a 6-digit number. In the table of the amino acid mutations of the wild type proteins of the selected splice variants of the invention, the header of the first column is "SNP position(s) on amino acid sequence", representing a position of a known mutation on amino acid sequence. SNPs may optionally be used as diagnostic markers according to the present invention, alone or in combination with one or more other SNPs and/or any other diagnostic marker. Preferred embodiments of the present invention comprise such SNPs, including but not limited to novel SNPs on the known (WT or wild type) protein sequences given below, as well as novel nucleic acid and/or amino acid sequences formed through such SNPs, and/or any SNP on a variant amino acid and/or nucleic acid sequence described herein.

Information given in the text with regard to the Homology to the known proteins was determined by Smith-Waterman version 5.1.2 using special (non default) parameters as follows: TABLE-US-00001 model=sw.model GAPEXT=0 GAPOP=100.0 MATRIX=blosum100

Information is given with regard to overexpression of a cluster in cancer based on ESTs. A key to the p values with regard to the analysis of such overexpression is as follows:

library-based statistics: P-value without including the level of expression in cell-lines (P1)

library based statistics: P-value including the level of expression in cell-lines (P2)

EST clone statistics: P-value without including the level of expression in cell-lines (SP1)

EST clone statistics: predicted overexpression ratio without including the level of expression in cell-lines (R3)

EST clone statistics: P-value including the level of expression in cell-lines (SP2)

EST clone statistics: predicted overexpression ratio including the level of expression in cell-lines (R4)

Library-based statistics refer to statistics over an entire library, while EST clone statistics refer to expression only for ESTs from a particular tissue or cancer.

Information is given with regard to overexpression of a cluster in cancer based on microarrays. As a microarray reference, in the specific segment paragraphs, the unabbreviated tissue name was used as the reference to the type of chip for which expression was measured. There are two types of microarray results: those from microarrays prepared according to a design by the present inventors, for which the microarray fabrication procedure is described in detail in Materials and Experimental Procedures section herein; and those results from microarrays using Affymetrix technology. As a microarray reference, in the specific segment paragraphs, the unabbreviated tissue name was used as the reference to the type of chip for which expression was measured. For microarrays prepared according to a design by the present inventors, the probe name begins with the name of the cluster (gene), followed by an identifying number. Oligonucleotide microarray results taken from Affymetrix data were from chips available from Affymetrix Inc, Santa Clara, Calif., USA (see for example data regarding the Human Genome U133 (HG-U133) Set at affymetrix.com/products/arrays/specific/hgu133.affx; GeneChip Human Genome U133A 2.0 Array at affymetrix.com/products/arrays/specific/hgu-133av2.affx; and Human Genome U133 Plus 2.0 Array at affymetrix.com/products/arrays/specific/hgu133plus.affx). The probe names follow the Affymetrix naming convention. The data is available from NCBI Gene Expression Omnibus (see ncbi.nlm.nih.gov/projects/geo/ and Edgar et al, Nucleic Acids Research, 2002, Vol. 30, No. 1207-210). The dataset (including results) is available from ncbi.nlm.nih.gov/geo/query/acc.cgi?acc=GSE1133 for the Series GSE1133 database (published on March 2004); a reference to these results is as follows: Su et al (Proc Natl Acad Sci USA. Apr. 20; 2004 101 (16):6062-7. Epub Apr. 9, 2004). The probes designed according to the present inventors are listed below. TABLE-US-00002>Z21368__0__0__61857

```
>Z21368_0_0_61857
AGTTCATCCTTCTTCAGTGTGACCAGTAAATTCT    (SEQ ID NO:895)
TCCCATACTCTTGAAG

>HUMGRP5E_0_0_16630
GCTGATATGGAAGTTGGGGAATCTGAATTGCCAG    (SEQ ID NO:896)
AGAATCTTGGGAAGAG

>HUMGRP5E_0_2_0
TCTCATAGAAGCAAAGGAGAACAGAAACCACCAG    (SEQ ID NO:897)
CCACCTCAACCCAAGG

>HSENA78_0_1_0
TGAAGAGTGTGAGGAAAACCTATGTTTGCCGCTT    (SEQ ID NO:898)
AAGCTTTCAGCTCAGC

>M85491_0_0_25999
GACATCTTTGCATATCATGTCAGAGCTATAACAT    (SEQ ID NO:899)
CATTGTGGAGAAGCTC

>M85491_0_14_0
GTCATGAAAATCAACACCGAGGTGCGGAGCTTCG    (SEQ ID NO:900)
GACCTGTGTCCCGCAG

>HSSTROL3_0_0_12518
ATGAGAGTAACCTCACCCGTGCACTAGTTTACAG    (SEQ ID NO:901)
AGCATTCACTGCCCCA

>HSSTROL3_0_0_12517
CAGAGATGAGAGCCTGGAGCATTGCAGATGCCAG    (SEQ ID NO:902)
GGACTTCACAAATGAA

>HUMCA1XIA_0_0_14909
GCTGCAATCTAAGTTTCGGAATACTTATACCACT    (SEQ ID NO:903)
CCAGAAATAATCCTCG

>HUMCA1XIA_0_18_0
TTCAGAACTGTTAACATCGCTGACGGGAAGTGGC    (SEQ ID NO:904)
ATCGGGTAGCAATCAG

>R20779_0_0_30670
CCGCGTTGCTTCTAGAGGCTGAATGCCTTTCAAA    (SEQ ID NO:905)
TGGAGAAGGCTTCCAT

>HSS100PCB_0_0_12280
CTCAAAATGAAACTCCCTCTCGCAGAGCACAATT    (SEQ ID NO:906)
CCAATTCGCTCTAAAA

>HSCOC4_0_0_9892
AAGGACCAGAGTCCATGCCAAGACCACCCTTCAG    (SEQ ID NO:907)
CTTCCAAGGCCCTCCA

>HSCOC4_0_39_0
ATCCTCCAGCCATGAGGCTGCTCTGGGGGCTGAT    (SEQ ID NO:908)
CTGGGCATCCAGCTTC

>HSCOC4_0_0_9883
CCTGTTTGCTCTGACACCAACTTCCTACCCTCTC    (SEQ ID NO:909)
AGCCTCAAAGTAACTC

>HSCOC4_0_0_9885
GCTGAGGTGTGGCCGAGGACCTGACCATCTGGAA    (SEQ ID NO:910)
GTGTGAAAATCCCCTT

>T11628_0_9_0
ACAAGATCCCCGTGAAGTACCTGGAGTTCATCTC    (SEQ ID NO:911)
GGAATGCATCATCCAG

>T11628_0_0_45174
TAAACAATCAAAGAGCATGTTGGCCTGGTCCTTT    (SEQ ID NO:912)
GCTAGGTACTGTAGAG

-continued
>T11628_0_0_45161
TGCCTCGCCACAATGGCACCTGCCCTAAAATAGC    (SEQ ID NO:913)
TTCCCATGTGAGGGCT >M78076_0_7_0
GAGAAGATGAACCCGCTGGAACAGTATGAGCGAA    (SEQ ID NO:914)
AGGTGAATGCGTCTGT >HSMUC1A_0_37_0
AAAAGGAGACTTCGGCTACCCAGAGAAGTTCAGT    (SEQ ID NO:915)
GCCCAGCTCTACTGAG >HSMUC1A_0_0_11364
AAAGGCTGGCATAGGGGGAGGTTTCCCAGGTAGA    (SEQ ID NO:916)
AGAAGAAGTGTCAGCA >HSMUC1A_0_0_11365
AATTAACCCTTTGAGAGCTGGCCAGGACTCTGGA    (SEQ ID NO:917)
CTGATTACCCCAGCCT
```

The following list of abbreviations for tissues was used in the TAA histograms. The term "TAA" stands for "Tumor Associated Antigen", and the TAA histograms, given in the text, represent the cancerous tissue expression pattern as predicted by the biomarkers selection engine, as described in detail in examples 1-5 below. TABLE-US-00003 "BONE" for "bone"; "COL" for "colon"; "EPI" for "epithelial"; "GEN" for "general"; "LIVER" for "liver"; "LUN" for "lung"; "LYMPH" for "lymph nodes"; "MARROW" for "bone marrow"; "OVA" for "ovary"; "PANCREAS" for "pancreas"; "PRO" for "prostate"; "STOMACH" for "stomach"; "TCELL" for "T cells"; "THYROID" for "Thyroid"; "MAM" for "breast"; "BRAIN" for "brain"; "UTERUS" for "uterus"; "SKIN" for "skin"; "KIDNEY" for "kidney"; "MUSCLE" for "muscle"; "ADREN" for "adrenal"; "HEAD" for "head and neck"; "BLADDER" for "bladder";

It should be noted that the terms "segment", "seg" and "node" are used interchangeably in reference to nucleic acid sequences of the present invention, they refer to portions of nucleic acid sequences that were shown to have one or more properties as described below. They are also the building blocks that were used to construct complete nucleic acid sequences as described in greater detail below. Optionally and preferably, they are examples of oligonucleotides which are embodiments of the present invention, for example as amplicons, hybridization units and/or from which primers and/or complementary oligonucleotides may optionally be derived, and/or for any other use.

As used herein the phrase "breast cancer" refers to cancers of the breast or surrounding tissue, including but not limited to ductal carcinoma (in-situ or invasive), lobular carcinoma (in-situ or invasive), inflammatory breast cancer, mucinous carcinoma, tubular carcinoma, or Paget's disease of the nipple, as well as conditions that are indicative of a higher risk factor for later development of breast cancer, including but not limited to ductal hyperplasia without atypia and atypical hyperplasia, referred to herein collectively as "indicative conditions".

The term "marker" in the context of the present invention refers to a nucleic acid fragment, a peptide, or a polypeptide, which is differentially present in a sample taken from subjects (patients) having breast cancer (or one of the above indicative conditions) as compared to a comparable sample taken from subjects who do not have breast cancer (or one of the above indicative conditions).

The phrase "differentially present" refers to differences in the quantity of a marker present in a sample taken from patients having breast cancer (or one of the above indicative conditions) as compared to a comparable sample taken from patients who do not have breast cancer (or one of the above indicative conditions). For example, a nucleic acid fragment may optionally be differentially present between the two samples if the amount of the nucleic acid fragment in one sample is significantly different from the amount of the nucleic acid fragment in the other sample, for example as measured by hybridization and/or NAT-based assays. A polypeptide is differentially present between the two samples if the amount of the polypeptide in one sample is significantly different from the amount of the polypeptide in the other sample. It should be noted that if the marker is detectable in one sample and not detectable in the other, then such a marker can be considered to be differentially present.

As used herein the phrase "diagnostic" means identifying the presence or nature of a pathologic condition. Diagnostic methods differ in their sensitivity and specificity. The "sensitivity" of a diagnostic assay is the percentage of diseased individuals who test positive (percent of "true positives"). Diseased individuals not detected by the assay are "false negatives." Subjects who are not diseased and who test negative in the assay are termed "true negatives." The "specificity" of a diagnostic assay is 1 minus the false positive rate, where the "false positive" rate is defined as the proportion of those without the disease who test positive. While a particular diagnostic method may not provide a definitive diagnosis of a condition, it suffices if the method provides a positive indication that aids in diagnosis.

As used herein the phrase "diagnosing" refers to classifying a disease or a symptom, determining a severity of the disease, monitoring disease progression, forecasting an outcome of a disease and/or prospects of recovery. The term "detecting" may also optionally encompass any of the above.

Diagnosis of a disease according to the present invention can be effected by determining a level of a polynucleotide or a polypeptide of the present invention in a biological sample obtained from the subject, wherein the level determined can be correlated with predisposition to, or presence or absence of the disease. It should be noted that a "biological sample obtained from the subject" may also optionally comprise a sample that has not been physically removed from the subject, as described in greater detail below.

As used herein, the term "level" refers to expression levels of RNA and/or protein or to DNA copy number of a marker of the present invention.

Typically the level of the marker in a biological sample obtained from the subject is different (i.e., increased or decreased) from the level of the same variant in a similar sample obtained from a healthy individual (examples of biological samples are described herein).

Numerous well known tissue or fluid collection methods can be utilized to collect the biological sample from the subject in order to determine the level of DNA, RNA and/or polypeptide of the variant of interest in the subject.

Examples include, but are not limited to, fine needle biopsy, needle biopsy, core needle biopsy and surgical biopsy (e.g., brain biopsy), and lavage. Regardless of the procedure employed, once a biopsy/sample is obtained the level of the variant can be determined and a diagnosis can thus be made.

Determining the level of the same variant in normal tissues of the same origin is preferably effected along-side to detect an elevated expression and/or amplification and/or a decreased expression, of the variant as opposed to the normal tissues.

A "test amount" of a marker refers to an amount of a marker in a subject's sample that is consistent with a diagnosis of breast cancer (or one of the above indicative conditions). A test amount can be either in absolute amount (e.g., microgram/ml) or a relative amount (e.g., relative intensity of signals).

A "control amount" of a marker can be any amount or a range of amounts to be compared against a test amount of a marker. For example, a control amount of a marker can be the amount of a marker in a patient with breast cancer (or one of the above indicative conditions) or a person without breast cancer (or one of the above indicative conditions). A control amount can be either in absolute amount (e.g., microgram/ml) or a relative amount (e.g., relative intensity of signals). "Detect" refers to identifying the presence, absence or amount of the object to be detected.

A "label" includes any moiety or item detectable by spectroscopic, photochemical, biochemical, immunochemical, or chemical means. For example, useful labels include $^{32}P$, $^{35}S$, fluorescent dyes, electron-dense reagents, enzymes (e.g., as commonly used in an ELISA), biotin-streptavadin, dioxigenin, haptens and proteins for which antisera or monoclonal antibodies are available, or nucleic acid molecules with a sequence complementary to a target. The label often generates a measurable signal, such as a radioactive, chromogenic, or fluorescent signal, that can be used to quantify the amount of bound label in a sample. The label can be incorporated in or attached to a primer or probe either covalently, or through ionic, van der Waals or hydrogen bonds, e.g., incorporation of radioactive nucleotides, or biotinylated nucleotides that are recognized by streptavadin. The label may be directly or indirectly detectable. Indirect detection can involve the binding of a second label to the first label, directly or indirectly. For example, the label can be the ligand of a binding partner, such as biotin, which is a binding partner for streptavadin, or a nucleotide sequence, which is the binding partner for a complementary sequence, to which it can specifically hybridize. The binding partner may itself be directly detectable, for example, an antibody may be itself labeled with a fluorescent molecule. The binding partner also may be indirectly detectable, for example, a nucleic acid having a complementary nucleotide sequence can be a part of a branched DNA molecule that is in turn detectable through hybridization with other labeled nucleic acid molecules (see, e.g., P. D. Fahrlander and A. Klausner, Bio/Technology 6:1165 (1988)). Quantitation of the signal is achieved by, e.g., scintillation counting, densitometry, or flow cytometry.

Exemplary detectable labels, optionally and preferably for use with immunoassays, include but are not limited to magnetic beads, fluorescent dyes, radiolabels, enzymes (e.g., horse radish peroxidase, alkaline phosphatase and others commonly used in an ELISA), and calorimetric labels such as colloidal gold or colored glass or plastic beads. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

"Immunoassay" is an assay that uses an antibody to specifically bind an antigen. The immunoassay is characterized by the use of specific binding properties of a particular antibody to isolate, target, and/or quantify the antigen.

The phrase "specifically (or selectively) binds" to an antibody or "specifically (or selectively) immunoreactive with," when referring to a protein or peptide (or other epitope), refers to a binding reaction that is determinative of the presence of the protein in a heterogeneous population of proteins and other biologics. Thus, under designated immunoassay conditions, the specified antibodies bind to a particular protein at least two times greater than the background (non-specific signal) and do not substantially bind in a significant amount to other proteins present in the sample. Specific binding to an antibody under such conditions may require an antibody that is selected for its specificity for a particular protein. For example, polyclonal antibodies raised to seminal basic protein from specific species such as rat, mouse, or human can be selected to obtain only those polyclonal antibodies that are specifically immunoreactive with seminal basic protein and not with other proteins, except for polymorphic variants and alleles of seminal basic protein. This selection may be achieved by subtracting out antibodies that cross-react with seminal basic protein molecules from other species. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, Antibodies, A Laboratory Manual (1988), for a description of immunoassay formats and conditions that can be used to determine specific immunoreactivity). Typically a specific or selective reaction will be at least twice background signal or noise and more typically more than 10 to 100 times background.

According to preferred embodiments of the present invention, there is provided an isolated polynucleotide comprising a nucleic acid sequence in the table below and/or: TABLE-US-00004 Transcript Name T10888_PEA_1_T1 (SEQ ID NO: 1) T0888_PEA_1_T4 (SEQ ID NO: 2) T10888_PEA1_T5 (SEQ ID NO: 3) T10888_PEA_1_T6 (SEQ ID NO: 4)

a nucleic acid sequence comprising a sequence in the table below: TABLE-US-00005 Segment Name T10888_PEA_1_node_11 (SEQ ID NO: 5) T10888_PEA_1_node_12 (SEQ ID NO: 6) T10888_PEA_1_node_17 (SEQ ID NO: 7) T0888_PEA_1_node_4 (SEQ ID NO: 8) T10888_PEA_1_node_6 (SEQ ID NO: 9) T10888_PEA_1_node_7 (SEQ ID NO: 10) T10888_PEA_1_node_9 (SEQ ID NO: 11) T10888_PEA_1_node_15 (SEQ ID NO: 12)

According to preferred embodiments of the present invention, there is provided an isolated polypeptide comprising an amino acid sequence in the table below amino acid sequence comprising a sequence in the table below: TABLE-US-00006 Protein Name T10888_PEA_1_P2 (SEQ ID NO: 14) T10888_PEA_1_P4 (SEQ ID NO: 15) T10888_PEA_1_P5 (SEQ ID NO: 16) T10888_PEA_1_P6 (SEQ ID NO: 17)

According to preferred embodiments of the present invention, there is provided an isolated polynucleotide comprising a nucleic acid sequence in the table below and/or: TABLE-US-00007 Transcript Name T39971_T10 (SEQ ID NO: 18) T39971_T12 (SEQ ID NO: 19) T39971_T16 (SEQ ID NO: 20) T39971_T5 (SEQ ID NO: 21)

a nucleic acid sequence comprising a sequence in the table below: TABLE-US-00008 Segment Name T39971_node_0 (SEQ ID NO: 22) T39971_node_18 (SEQ ID NO: 23) T39971_node_21 (SEQ ID NO: 24) T39971_node_22 (SEQ ID NO: 25) T39971_node_23 (SEQ ID NO: 26) T39971_node_31 (SEQ ID NO: 27) T39971_node_33 (SEQ ID NO: 28) T39971_node_7 (SEQ ID NO: 29) T39971_node_1 (SEQ ID NO: 30) T39971_node_10 (SEQ ID NO: 31) T39971_node_11 (SEQ ID NO: 32) T39971_node_12 (SEQ ID NO: 33) T39971_node_15 (SEQ ID NO: 34) T39971_node_16 (SEQ ID NO: 35) T39971_node_17 (SEQ ID NO: 36) T39971_node_26 (SEQ ID NO: 37) T39971_node_27 (SEQ ID NO: 38) T39971_node_28 (SEQ ID NO: 39) T39971_node_29 (SEQ ID NO: 40) T39971_node_3 (SEQ ID NO: 41) T39971_node_30 (SEQ ID NO: 42) T39971_node_34 (SEQ ID NO: 43) T39971_node_35 (SEQ ID NO: 44) T39971_node_36 (SEQ ID NO: 45) T39971_node_4 (SEQ ID NO: 46) T39971_node_5 (SEQ ID NO: 47) T39971_node_8 (SEQ ID NO: 48) T39971_node_9 (SEQ ID NO: 49)

According to preferred embodiments of the present invention, there is provided an isolated polypeptide comprising an amino acid sequence in the table below: TABLE-US-00009 Protein Name T39971_P6 (SEQ ID NO: 51) T39971_P9 (SEQ ID NO: 52) T39971_P11 (SEQ ID NO: 53) T39971_P12 (SEQ ID NO: 54)

According to preferred embodiments of the present invention, there is provided an isolated polynucleotide comprising a nucleic acid sequence in the table below and/or: TABLE-US-00010 Transcript Name Z21368_PEA_1_T10 (SEQ ID NO: 55) Z21368_PEA_1T11 (SEQ ID NO: 56) Z21368_PEA_1_T23 (SEQ ID NO: 57) Z21368_PEA_1_T24 (SEQ ID NO: 58) Z21368_PEA_1_T5 (SEQ ID NO: 59) Z21368_PEA_1_T6 (SEQ ID NO: 60) Z21368_PEA_1_T9 (SEQ ID NO: 61)

a nucleic acid sequence comprising a sequence in the table below: TABLE-US-00011 Segment Name Z21368_PEA_1_node_0 (SEQ ID NO: 62) Z21368_PEA_1_node_15 (SEQ ID NO: 63) Z21368_PEA_1_node_19 (SEQ ID NO: 64) Z21368_PEA_1_node_2 (SEQ ID NO: 65) Z21368_PEA_1_node_21 (SEQ ID NO: 66) Z21368_PEA_1_node_33 (SEQ ID NO: 67) Z21368_PEA_1_node_36 (SEQ ID NO: 68) Z21368_PEA_1_node_37 (SEQ ID NO: 69) Z21368_PEA_1_node_39 (SEQ ID NO: 70) Z21368_PEA_1_node_4 (SEQ ID NO: 71) Z21368_PEA_1_node_41 (SEQ ID NO: 72) Z21368_PEA_1_node_43 (SEQ ID NO: 73) Z21368_PEA_1_node_45 (SEQ ID NO: 74) Z21368_PEA_1_node_53 (SEQ ID NO: 75) Z21368_PEA_1_node_56 (SEQ ID NO: 76) Z21368_PEA_1_node_58 (SEQ ID NO: 77) Z21368_PEA_1_node_66 (SEQ ID NO: 78) Z21368_PEA_1_node_67 (SEQ ID NO: 79) Z21368_PEA_1_node_69 (SEQ ID NO: 80) Z21368_PEA_1_node_11 (SEQ ID NO: 81) Z21368_PEA_1_node_12 (SEQ ID NO: 82) Z21368_PEA_1_node_16 (SEQ ID NO: 83) Z21368_PEA_1_node_17 (SEQ ID NO: 84) Z21368_PEA_1_node_23 (SEQ ID NO: 85) Z21368_PEA_1_node_24 (SEQ ID NO: 86) Z21368_PEA_1_node_30 (SEQ ID NO: 87) Z21368_PEA_1_node_31 (SEQ ID NO: 88) Z21368_PEA_1_node_38 (SEQ ID NO: 89) Z21368_PEA_1_node_47 (SEQ ID NO: 90) Z21368_PEA_1_node_49 (SEQ ID NO: 91) Z21368_PEA_1_node_51 (SEQ ID NO: 92) Z21368_PEA_1_node_61 (SEQ ID NO: 93) Z21368_PEA_1_node_68 (SEQ ID NO: 94) Z21368_PEA_1_node_7 (SEQ ID NO: 95)

According to preferred embodiments of the present invention, there is provided an isolated polypeptide comprising an amino acid sequence in the table below TABLE-US-00012 Protein Name Z21368_PEA_1_P2 (SEQ ID NO: 97) Z21368_PEA_1_P5 (SEQ ID NO: 98) Z21368_PEA_1_P15 (SEQ ID NO: 99) Z21368_PEA_1_P16 (SEQ ID NO: 100) Z21368_PEA_1_P22 (SEQ ID NO: 101) Z21368_PEA_1P23 (SEQ ID NO: 102)

According to preferred embodiments of the present invention, there is provided an isolated polynucleotide comprising a nucleic acid sequence in the table below and/or: TABLE-US-00013 Transcript Name T59832_T11 (SEQ ID NO: 103) T59832_T15 (SEQ ID NO: 104) T59832_T22 (SEQ ID NO:

105) T59832_T28 (SEQ ID NO: 106) T59832_T6 (SEQ ID NO: 107) T59832_T8 (SEQ ID NO: 108)

a nucleic acid sequence comprising a sequence in the table below: TABLE-US-00014 Segment Name T59832_node_1 (SEQ ID NO: 109) T59832_node_22 (SEQ ID NO: 110) T59832_node_23 (SEQ ID NO: 111) T59832_node_24 (SEQ ID NO: 112) T59832_node_29 (SEQ ID NO: 113) T59832_node_39 (SEQ ID NO: 114) T59832_node_7 (SEQ ID NO: 115) T59832_node_10 (SEQ ID NO: 116) T59832_node_11 (SEQ ID NO: 117) T59832_node_12 (SEQ ID NO: 118) T59832_node_14 (SEQ ID NO: 119) T59832_node_16 (SEQ ID NO: 120) T59832_node_19 (SEQ ID NO: 121) T59832_node_2 (SEQ ID NO: 122) T59832_node_20 (SEQ ID NO: 123) T59832_node_25 (SEQ ID NO: 124) T59832_node_26 (SEQ ID NO: 125) T59832_node_27 (SEQ ID NO: 126) T59832_node_28 (SEQ ID NO: 127) T59832_node_3 (SEQ ID NO: 128) T59832_node_30 (SEQ ID NO: 129) T59832_node_31 (SEQ ID NO: 130) T59832_node_32 (SEQ ID NO: 131) T59832_node_34 (SEQ ID NO: 132) T59832_node_35 (SEQ ID NO: 133) T59832_node_36 (SEQ ID NO: 134) T59832_node_37 (SEQ ID NO: 135) T59832_node_38 (SEQ ID NO: 136) T59832_node_4 (SEQ ID NO: 137) T59832_node_5 (SEQ ID NO: 138) T59832_node_6 (SEQ ID NO: 139) T59832_node_8 (SEQ ID NO: 140) T59832_node_9 (SEQ ID NO: 141)

According to preferred embodiments of the present invention, there is provided an isolated polypeptide comprising an amino acid sequence in the table below TABLE-US-00015 Protein Name T59832_P5 (SEQ ID NO: 143) T59832_P7 (SEQ ID NO: 144) T59832_P9 (SEQ ID NO: 145) T59832_P12 (SEQ ID NO: 146) T59832_P18 (SEQ ID NO: 147)

According to preferred embodiments of the present invention, there is provided an isolated polynucleotide comprising a nucleic acid sequence in the table below and/or: TABLE-US-00016 Transcript Name Z41644_PEA_1_T5 (SEQ ID NO: 208)

a nucleic acid sequence comprising a sequence in the table below: TABLE-US-00017 Segment Name Z41644_PEA_1_node_0 (SEQ ID NO: 209) Z41644_PEA_1_node_11 (SEQ ID NO: 210) Z41644_PEA_1_node_12 (SEQ ID NO: 211) Z41644_PEA_1_node_15 (SEQ ID NO: 212) Z41644_PEA_1_node_20 (SEQ ID NO: 213) Z41644_PEA_1_node_24 (SEQ ID NO: 214) Z41644_PEA_1_node_1 (SEQ ID NO: 215) Z41644_PEA_1_node_10 (SEQ ID NO: 216) Z41644_PEA_1_node_13 (SEQ ID NO: 217) Z41644_PEA_1_node_16 (SEQ ID NO: 218) Z41644_PEA_1_node_17 (SEQ ID NO: 219) Z41644_PEA_1_node_19 (SEQ ID NO: 220) Z41644_PEA_1_node_2 (SEQ ID NO: 221) Z41644_PEA_1_node_21 (SEQ ID NO: 222) Z41644_PEA_1_node_22 (SEQ ID NO: 223) Z41644_PEA_1_node_23 (SEQ ID NO: 224) Z41644_PEA_1_node_25 (SEQ ID NO: 225) Z41644_PEA_1_node_3 (SEQ ID NO: 226) Z41644_PEA_1_node_4 (SEQ ID NO: 227) Z41644_PEA_1_node_6 (SEQ ID NO: 228) Z41644_PEA_1_node_9 (SEQ ID NO: 229)

According to preferred embodiments of the present invention, there is provided an isolated polypeptide comprising an amino acid sequence in the table below TABLE-US-00018 Protein Name Z41644_PEA_1_P10 (SEQ ID NO: 231)

According to preferred embodiments of the present invention, there is provided an isolated polynucleotide comprising a nucleic acid sequence in the table below and/or: TABLE-US-00019 Transcript Name HUMGRP5E_T4 (SEQ ID NO:148) HUMGRP5E_T5 (SEQ ID NO:149)

a nucleic acid sequence comprising a sequence in the table below: TABLE-US-00020 Segment Name HUMGRP5E_node_0 (SEQ ID NO:150) HUMGRP5E_node_2 (SEQ ID NO:151) HUMGRP5E_node_8 (SEQ ID NO:152) HUMGRP5E_node_3 (SEQ ID NO:153) HUMGRP5E_node_7 (SEQ ID NO:154)

According to preferred embodiments of the present invention, there is provided an isolated polypeptide comprising an amino acid sequence in the table below TABLE-US-00021 Protein Name HUMGRP5E_P4 (SEQ ID NO:156) HUMGRP5E_P5 (SEQ ID NO:157)

According to preferred embodiments of the present invention, there is provided an isolated polynucleotide comprising a nucleic acid sequence in the table below and/or: TABLE-US-00022 Transcript Name M155578_PEA_1_T10 (SEQ ID NO: 158) AA155578_PEA_1_T12 (SEQ ID NO: 159) AA155578_PEA_1_T13 (SEQ ID NO: 160) AA155578_PEA_1_T8 (SEQ ID NO: 161)

a nucleic acid sequence comprising a sequence in the table below: TABLE-US-00023 Segment Name AA155578_PEA_1_node_11 (SEQ ID NO: 162) AA155578_PEA_1_node_12 (SEQ ID NO: 163) AA155578_PEA_1_node_14 (SEQ ID NO: 164) AA155578_PEA_1_node_19 (SEQ ID NO: 165) AA155578_PEA_1_node_21 (SEQ ID NO: 166) AA155578_PEA_1_node_23 (SEQ ID NO: 167) AA155578_PEA_1_node_24 (SEQ ID NO: 168) AA155578_PEA_1_node_25 (SEQ ID NO: 169) AA155578_PEA_1_node_4 (SEQ ID NO: 170) AA155578_PEA_1_node_7 (SEQ ID NO: 171) AA155578_PEA_1_node_15 (SEQ ID NO: 172) AA155578_PEA_1_node_18 (SEQ ID NO: 173) AA155578_PEA_1_node_22 (SEQ ID NO: 174) AA155578_PEA_1_node_6 (SEQ ID NO: 175) AA155578_PEA_1_node_8 (SEQ ID NO: 176)

According to preferred embodiments of the present invention, there is provided an isolated polypeptide comprising an amino acid sequence in the table below TABLE-US-00024 Protein Name AA155578_PEA_1_P4 (SEQ ID NO: 178) AA155578_PEA_1_P6 (SEQ ID NO: 179) AA155578_PEA_1_P8 (SEQ ID NO: 180) AA155578_PEA_1_P9 (SEQ ID NO: 181)

According to preferred embodiments of the present invention, there is provided an isolated polynucleotide comprising a nucleic acid sequence in the table below and/or: TABLE-US-00025 Transcript Name HSENA78_T5 (SEQ ID NO:182)

a nucleic acid sequence comprising a sequence in the table below: TABLE-US-00026 Segment Name HSENA78_node_0 (SEQ ID NO:183) HSENA78_node_2 (SEQ ID NO:184) HSENA78_node_6 (SEQ ID NO:185) HSENA78_node_9 (SEQ ID NO:186) HSENA78_node_3 (SEQ ID NO:187) HSENA78_node_4 (SEQ ID NO:188) HSENA78_node_8 (SEQ ID NO:189)

According to preferred embodiments of the present invention, there is provided an isolated polypeptide comprising an amino acid sequence in the table below: TABLE-US-00027 Protein Name HSENA78_P2 (SEQ ID NO:191)

According to preferred embodiments of the present invention, there is provided an isolated polynucleotide comprising a nucleic acid sequence in the table below and/or: TABLE-US-00028 Transcript Name T94936_PEA_1_T1 (SEQ ID NO: 192) T94936_PEA_1_T2 (SEQ ID NO: 193)

a nucleic acid sequence comprising a sequence in the table below: TABLE-US-00029 Segment Name T94936_PEA_1_node_14 (SEQ ID NO: 194) T94936_PEA_1_node_16 (SEQ ID NO: 195) T94936_PEA_1_node_2 (SEQ ID NO: 196) T94936_PEA_1_node_20 (SEQ ID NO: 197) T94936_PEA_1_node_23 (SEQ ID NO: 198) T94936_PEA_1_node_0 (SEQ ID NO: 199) T94936_PEA_1_node_11 (SEQ ID NO: 200) T94936_PEA_1_node_13 (SEQ ID NO: 201) T94936_PEA_1_node_17 (SEQ ID NO: 202) T94936_PEA_1_node_6 (SEQ ID NO: 203) T94936_PEA_1_node_8 (SEQ ID NO: 204) T94936_PEA_1_node_9 (SEQ ID NO: 205)

According to preferred embodiments of the present invention, there is provided an isolated polypeptide comprising an amino acid sequence in the table below TABLE-US-00030 Protein Name T94936_PEA_1_P2 (SEQ ID NO: 206) T94936_PEA_1_P3 (SEQ ID NO: 207)

According to preferred embodiments of the present invention, there is provided an isolated polynucleotide comprising a nucleic acid sequence in the table below and/or: TABLE-US-00031 Transcript Name M85491_PEA_1_T16 (SEQ ID NO: 232) M85491_PEA_1_T20 (SEQ ID NO: 233)

a nucleic acid sequence comprising a sequence in the table below: TABLE-US-00032 Segment Name M85491_PEA_1_node_0 (SEQ ID NO: 234) M85491_PEA_1_node_13 (SEQ ID NO: 235) M85491_PEA_1_node_21 (SEQ ID NO: 236) M85491_PEA_1_node_23 (SEQ ID NO: 237) M85491_PEA_1_node_24 (SEQ ID NO: 238) M85491_PEA_1_node_8 (SEQ ID NO: 239) M85491_PEA_1_node_9 (SEQ ID NO: 240) M85491_PEA_1_node_10 (SEQ ID NO: 241) M85491_PEA_1_node_18 (SEQ ID NO: 242) M85491_PEA_12_node_19 (SEQ ID NO: 243) M85491_PEA_1_node_6 (SEQ ID NO: 244)

According to preferred embodiments of the present invention, there is provided an isolated polypeptide comprising an amino acid sequence in the table below TABLE-US-00033 Protein Name M85491_PEA_1_P13 (SEQ ID NO: 246) M85491_PEA_1_P14 (SEQ ID NO: 247)

According to preferred embodiments of the present invention, there is provided an isolated polynucleotide comprising a nucleic acid sequence in the table below and/or: TABLE-US-00034 Transcript Name HSSTROL3_T5 (SEQ ID NO:248) HSSTROL3_T8 (SEQ ID NO:249) HSSTROL3_T9 (SEQ ID NO:250) HSSTROL3_T10 (SEQ ID NO:251) HSSTROL3_T11 (SEQ ID NO:252) HSSTROL3_T12 (SEQ ID NO:253)

a nucleic acid sequence comprising a sequence in the table below: TABLE-US-00035 Segment Name HSSTROL3_node_6 (SEQ ID NO:254) HSSTROL3_node_10 (SEQ ID NO:255) HSSTROL3_node_13 (SEQ ID NO:256) HSSTROL3_node_15 (SEQ ID NO:257) HSSTROL3_node_19 (SEQ ID NO:258) HSSTROL3_node_21 (SEQ ID NO:259) HSSTROL3_node_24 (SEQ ID NO:260) HSSTROL3_node_25 (SEQ ID NO:261) HSSTROL3_node_26 (SEQ ID NO:262) HSSTROL3_node_28 (SEQ ID NO:263) HSSTROL3_node_29 (SEQ ID NO:264) HSSTROL3_node_11 (SEQ ID NO:265) HSSTROL3_node_17 (SEQ ID NO:266) HSSTROL3_node_18 (SEQ ID NO:267) HSSTROL3_node_20 (SEQ ID NO:268) HSSTROL3_node_27 (SEQ ID NO:269)

According to preferred embodiments of the present invention, there is provided an isolated polypeptide comprising an amino acid sequence in the table below TABLE-US-00036 Protein Name HSSTROL3_P4 (SEQ ID NO:271) HSSTROL3_P5 (SEQ ID NO:272) HSSTROL3_P7 (SEQ ID NO:273) HSSTROL3_P8 (SEQ ID NO:274) HSSTROL3_P9 (SEQ ID NO:275)

According to preferred embodiments of the present invention, there is provided an isolated polynucleotide comprising a nucleic acid sequence in the table below and/or: TABLE-US-00037 Transcript Name AY180924_PEA_1_T1 (SEQ ID NO: 276)

a nucleic acid sequence comprising a sequence in the table below: TABLE-US-00038 Segment Name AY180924_PEA_1_node_3 (SEQ ID NO: 277) AY180924_PEA_1_node_0 (SEQ ID NO: 278) AY180924_PEA_1_node_2 (SEQ ID NO: 279)

According to preferred embodiments of the present invention, there is provided an isolated polypeptide comprising an amino acid sequence in the table below TABLE-US-00039 Protein Name AY180924_PEA_1_P3 (SEQ ID NO: 281)

According to preferred embodiments of the present invention, there is provided an isolated polynucleotide comprising a nucleic acid sequence in the table below and/or: TABLE-US-00040 Transcript Name R75793_PEA_1_T1 (SEQ ID NO: 282) R75793_PEA_1_T3 (SEQ ID NO: 283) R75793_PEA_1_T5 (SEQ ID NO: 284)

a nucleic acid sequence comprising a sequence in the table below: TABLE-US-00041 R75793_PEA_1_node_0 (SEQ ID NO: 285) R75793_PEA_1_node_9 (SEQ ID NO: 286) R75793_PEA_1_node_11 (SEQ ID NO: 287) R75793_PEA_1_node_14 (SEQ ID NO: 288) R75793_PEA_1_node_4 (SEQ ID NO: 289) R75793_PEA_1_node_5 (SEQ ID NO: 290) R75793_PEA_1_node_6 (SEQ ID NO: 291) R75793_PEA_1_node_8 (SEQ ID NO: 292) R75793_PEA_1_node_13 (SEQ ID NO: 293)

According to preferred embodiments of the present invention, there is provided an isolated polypeptide comprising an amino acid sequence in the table below TABLE-US-00042 Protein Name R75793_PEA_1_P2 (SEQ ID NO: 295) R75793_PEA_1_P5 (SEQ ID NO: 296) R75793_PEA_1_P6 (SEQ ID NO: 297)

According to preferred embodiments of the present invention, there is provided an isolated polynucleotide comprising a nucleic acid sequence in the table below and/or: TABLE-US-00043 Transcript Name HUMCA1XIA_T16 (SEQ ID NO:298) HUMCA1XIA_T17 (SEQ ID NO:299) HUMCA1XIA_T19 (SEQ ID NO:300) HUMCA1XIA_T20 (SEQ ID NO:301)

a nucleic acid sequence comprising a sequence in the table below: TABLE-US-00044 Segment Name HUMCA1XIA_node_0 (SEQ ID NO:302) HUMCA1XIA_node_2 (SEQ ID NO:303) HUMCA1XIA_node_4 (SEQ ID NO:304) HUMCA1XIA_node_6 (SEQ ID NO:305) HUMCA1XIA_node_8 (SEQ ID NO:306) HUMCA1XIA_node_9 (SEQ ID NO:307) HUMCA1XIA_node_18 (SEQ ID NO:308) HUMCA1XIA_node_54 (SEQ ID NO:309) HUMCA1XIA_node_55 (SEQ ID NO:310) HUMCA1XIA_node_92 (SEQ ID NO:311) HUMCA1XIA_node_11 (SEQ ID NO:312) HUMCA1XIA_node_15 (SEQ ID NO:313) HUMCA1XIA_node_19 (SEQ ID NO:314) HUMCA1XIA_node_21 (SEQ ID NO:315) HUMCA1XIA_node_23 (SEQ ID NO:316)

HUMCA1XIA_node_25 (SEQ ID NO:317)
HUMCA1XIA_node_27 (SEQ ID NO:318)
HUMCA1XIA_node_29 (SEQ ID NO:319)
HUMCA1XIA_node_31 (SEQ ID NO:320)
HUMCA1XIA_node_33 (SEQ ID NO:321)
HUMCA1XIA_node_35 (SEQ ID NO:322)
HUMCA1XIA_node_37 (SEQ ID NO:323)
HUMCA1XIA_node_39 (SEQ ID NO:324)
HUMCA1XIA_node_41 (SEQ ID NO:325)
HUMCA1XIA_node_43 (SEQ ID NO:326)
HUMCA1XIA_node_45 (SEQ ID NO:327)
HUMCA1XIA_node_47 (SEQ ID NO:328)
HUMCA1XIA_node_49 (SEQ ID NO:329)
HUMCA1XIA_node_51 (SEQ ID NO:330)
HUMCA1XIA_node_57 (SEQ ID NO:331)
HUMCA1XIA_node_59 (SEQ ID NO:332)
HUMCA1XIA_node_62 (SEQ ID NO:333)
HUMCA1XIA_node_64 (SEQ ID NO:334)
HUMCA1XIA_node_66 (SEQ ID NO:335)
HUMCA1XIA_node_68 (SEQ ID NO:336)
HUMCA1XIA_node_70 (SEQ ID NO:337)
HUMCA1XIA_node_72 (SEQ ID NO:338)
HUMCA1XIA_node_74 (SEQ ID NO:339)
HUMCA1XIA_node_76 (SEQ ID NO:340)
HUMCA1XIA_node_78 (SEQ ID NO:341)
HUMCA1XIA_node_81 (SEQ ID NO:342)
HUMCA1XIA_node_83 (SEQ ID NO:343)
HUMCA1XIA_node_85 (SEQ ID NO:344)
HUMCA1XIA_node_87 (SEQ ID NO:345)
HUMCA1XIA_node_89 (SEQ ID NO:346)
HUMCA1XIA_node_91 (SEQ ID NO:347)

According to preferred embodiments of the present invention, there is provided an isolated polypeptide comprising an amino acid sequence in the table below TABLE-US-00045 Protein Name HUMCA1XIA_P14 (SEQ ID NO:350) HUMCA1XIA_P15 (SEQ ID NO:351) HUMCA1XIA_P16 (SEQ ID NO:352) HUMCA1XIA_P17 (SEQ ID NO:353)

According to preferred embodiments of the present invention, there is provided an isolated polynucleotide comprising a nucleic acid sequence in the table below and/or: TABLE-US-00046 Transcript Name R20779_T7 (SEQ ID NO: 354)

a nucleic acid sequence comprising a sequence in the table below: TABLE-US-00047 Segment Name R20779_node_0 (SEQ ID NO: 355) R20779_node_2 (SEQ ID NO: 356) R20779_node_7 (SEQ ID NO: 357) R20779_node_9 (SEQ ID NO: 358) R20779_node_18 (SEQ ID NO: 359) R20779_node_21 (SEQ ID NO: 360) R20779_node_24 (SEQ ID NO: 361) R20779_node_27 (SEQ ID NO: 362) R20779_node_28 (SEQ ID NO: 363) R20779_node_30 (SEQ ID NO: 364) R20779_node_31 (SEQ ID NO: 365) R20779_node_32 (SEQ ID NO: 366) R20779_node_1 (SEQ ID NO: 367) R20779_node_3 (SEQ ID NO: 368) R20779_node_10 (SEQ ID NO: 369) R20779_node_11 (SEQ ID NO: 370) R20779_node_14 (SEQ ID NO: 371) R20779_node_17 (SEQ ID NO: 372) R20779_node_19 (SEQ ID NO: 373) R20779_node20 (SEQ ID NO: 374) R20779_node_22 (SEQ ID NO: 375) R20779_node_23 (SEQ ID NO: 376) R20779_node_25 (SEQ ID NO: 377) R20779_node_29 (SEQ ID NO: 378)

According to preferred embodiments of the present invention, there is provided an isolated polypeptide comprising an amino acid sequence according to R20779_P2 (SEQ ID NO:380).

According to preferred embodiments of the present invention, there is provided an isolated polynucleotide comprising a nucleic acid sequence in the table below and/or: TABLE-US-00048 Transcript Name HSS100PCB_T1 (SEQ ID NO:381)

a nucleic acid sequence comprising a sequence in the table below: TABLE-US-00049 Segment Name HSS100PCB_node_3 (SEQ ID NO:382) HSS100PCB_node_4 (SEQ ID NO:383) HSS100PCB_node_5 (SEQ ID NO:384)

According to preferred embodiments of the present invention, there is provided an isolated polypeptide comprising an amino acid sequence according to HSS100PCB_P3 (SEQ ID NO:386).

According to preferred embodiments of the present invention, there is provided an isolated polynucleotide comprising a nucleic acid sequence in the table below and/or: TABLE-US-00050 Transcript Name HSCOC4_PEA_1_T1 (SEQ ID NO:387) HSCOC4_PEA_1_T2 (SEQ ID NO:388) HSCOC4_PEA_1_T3 (SEQ ID NO:389) HSCOC4_PEA_1_T4 (SEQ ID NO:390) HSCOC4_PEA_1_T5 (SEQ ID NO:391) HSCOC4_PEA_1_T7 (SEQ ID NO:392) HSCOC4_PEA_1_T8 (SEQ ID NO:393) HSCOC4_PEA_1_T11 (SEQ ID NO:394) HSCOC4_PEA_1_T12 (SEQ ID NO:395) HSCOC4_PEA_1_T14 (SEQ ID NO:396) HSCOC4_PEA_1_T15 (SEQ ID NO:397) HSCOC4_PEA_1_T20 (SEQ ID NO:398) HSCOC4_PEA_1_T21 (SEQ ID NO:399) HSCOC4_PEA_1_T25 (SEQ ID NO:400) HSCOC4_PEA_1_T28 (SEQ ID NO:401) HSCOC4_PEA_1_T30 (SEQ ID NO:402) HSCOC4_PEA_1_T31 (SEQ ID NO:403) HSCOC4_PEA_1_T32 (SEQ ID NO:404) HSCOC4_PEA_1_T40 (SEQ ID NO:405)

a nucleic acid sequence comprising a sequence in the table below: TABLE-US-00051 Segment Name HSCOC4_PEA_1_node_1 (SEQ ID NO:406) HSCOC4_PEA_1_node_5 (SEQ ID NO:407) HSCOC4_PEA_1_node_7 (SEQ ID NO:408) HSCOC4_PEA_1_node_30 (SEQ ID NO:409) HSCOC4_PEA_1_node_33 (SEQ ID NO:410) HSCOC4_PEA_1_node_35 (SEQ ID NO:411) HSCOC4_PEA_1_node_37 (SEQ ID NO:412) HSCOC4_PEA_1_node_39 (SEQ ID NO:413) HSCOC4_PEA_1_node_43 (SEQ ID NO:414) HSCOC4_PEA_1_node_48 (SEQ ID NO:415) HSCOC4_PEA_1_node_49 (SEQ ID NO:416) HSCOC4_PEA_1_node_51 (SEQ ID NO:417) HSCOC4_PEA_1_node_58 (SEQ ID NO:418) HSCOC4_PEA_1_node_59 (SEQ ID NO:419) HSCOC4_PEA_1_node_62 (SEQ ID NO:420) HSCOC4_PEA_1_node_66 (SEQ ID NO:421) HSCOC4_PEA_1_node_72 (SEQ ID NO:422) HSCOC4_PEA_1_node_77 (SEQ ID NO:423) HSCOC4_PEA_1_node_79 (SEQ ID NO:424) HSCOC4_PEA_1_node_93 (SEQ ID NO:425) HSCOC4_PEA_1_node_100 (SEQ ID NO:426) HSCOC4_PEA_1_node_105 (SEQ ID NO:427) HSCOC4_PEA_1_node_107 (SEQ ID NO:428) HSCOC4_PEA_1_node_108 (SEQ ID NO:429) HSCOC4_PEA_1_node_109 (SEQ ID NO:430) HSCOC4_PEA_1_node_110 (SEQ ID NO:431) HSCOC4_PEA_1_node_112 (SEQ ID NO:432) HSCOC4_PEA_1_node_113 (SEQ ID NO:433) HSCOC4_PEA_1_node_2 (SEQ ID NO:434) HSCOC4_PEA_1_node_8 (SEQ ID NO:435) HSCOC4_PEA_1_node_10 (SEQ ID NO:436) HSCOC4_PEA_1_node_12 (SEQ ID NO:437) HSCOC4_PEA_1_node_14 (SEQ ID NO:438) HSCOC4_PEA_1_node_17 (SEQ ID NO:439)

HSCOC4_PEA_1_node_19 (SEQ ID NO:440)
HSCOC4_PEA_1_node_21 (SEQ ID NO:441)
HSCOC4_PEA_1_node_22 (SEQ ID NO:442)
HSCOC4_PEA_1_node_28 (SEQ ID NO:443)
HSCOC4_PEA_1_node_29 (SEQ ID NO:444)
HSCOC4_PEA_1_node_41 (SEQ ID NO:445)
HSCOC4_PEA_1_node_45 (SEQ ID NO:446)
HSCOC4_PEA_1_node_47 (SEQ ID NO:447)
HSCOC4_PEA_1_node_50 (SEQ ID NO:448)
HSCOC4_PEA_1_node_53 (SEQ ID NO:449)
HSCQC4_PEA_1_node_55 (SEQ ID NO:450)
HSCOC4_PEA_1_node_57 (SEQ ID NO:451)
HSCOC4_PEA_1_node_60 (SEQ ID NO:452)
HSCOC4_PEA_1_node_64 (SEQ ID NO:453)
HSCOC4_PEA_1_node_69 (SEQ ID NO:454)
HSCOC4_PEA_1_node_70 (SEQ ID NO:455)
HSCOC4_PEA_1_node_71 (SEQ ID NO:456)
HSCOC4_PEA_1_node_73 (SEQ ID NO:457)
HSCOC4_PEA_1_node_74 (SEQ ID NO:458)
HSCOC4_PEA_1_node_75 (SEQ ID NO:459)
HSCOC4_PEA_1_node_76 (SEQ ID NO:460)
HSCOC4_PEA_1_node_78 (SEQ ID NO:461)
HSCOC4_PEA_1_node_80 (SEQ ID NO:462)
RSCOC4_PEA_1_node_82 (SEQ ID NO:463)
HSCOC4_PEA_1_node_83 (SEQ ID NO:464)
HSCOC4_PEA_1_node_84 (SEQ ID NO:465)
HSCOC4_PEA_1_node_85 (SEQ ID NO:466)
HSCOC4_PEA_1_node_86 (SEQ ID NO:467)
HSCOC4_PEA_1_node_87 (SEQ ID NO:468)
HSCOC4_PEA_1_node_88 (SEQ ID NO:469)
HSCOC4_PEA_1_node_89 (SEQ ID NO:470)
HSCOC4_PEA_1_node_90 (SEQ ID NO:471)
HSCOC4_PEA_1_node_91 (SEQ ID NO:472)
HSCOC4_PEA_1_node_92 (SEQ ID NO:473)
HSCOC4_PEA_1_node_94 (SEQ ID NO:474)
HSCOC4_PEA_1_node_96 (SEQ ID NO:475)
HSCOC4_PEA_1_node_97 (SEQ ID NO:476)
HSCOC4_PEA_1_node_98 (SEQ ID NO:477)
HSCOC4_PEA_1_node_99 (SEQ ID NO:478)
HSCOC4_PEA_1_node_101 (SEQ ID NO:479)
HSCOC4_PEA_1_node_102 (SEQ ID NO:480)
HSCOC4_PEA_1_node_103 (SEQ ID NO:481)
HSCOC4_PEA_1_node_104 (SEQ ID NO:482)
HSCOC4_PEA_1_node_106 (SEQ ID NO:483)
HSCOC4_PEA_1_node_111 (SEQ ID NO:484)

According to preferred embodiments of the present invention, there is provided an isolated polypeptide comprising an amino acid sequence in the table below TABLE-US-00052 Protein Name HSCOC4_PEA_1_P3 (SEQ ID NO:488) HSCOC4_PEA_1_P5 (SEQ ID NO:489) HSCOC4_PEA_1_P6 (SEQ ID NO:490) HSCOC4_PEA_1_P12 (SEQ ID NO:491) HSCOC4_PEA_1_P15 (SEQ ID NO:492) HSCOC4_PEA_1_P16 (SEQ ID NO:493) HSCOC4_PEA_1_P20 (SEQ ID NO:494) HSCOC4_PEA_1_P9 (SEQ ID NO:495) HSCOC4_PEA_1_P22 (SEQ ID NO:496) HSCOC4_PEA_1_P23 (SEQ ID NO:497) HSCOC4_PEA_1_P24 (SEQ ID NO:498) HSCOC4_PEA_1_P25 (SEQ ID NO:499) HSCOC4_PEA_1_P26 (SEQ ID NO:500) HSCOC4_PEA_1_P30 (SEQ ID NO:501) HSCOC4_PEA_1_P38 (SEQ ID NO:502) HSCOC4_PEA_1_P39 (SEQ ID NO:503) HSCOC4_PEA_1_P40 (SEQ ID NO:504) HSCOC4_PEA_1_P41 (SEQ ID NO:505) HSCOC4_PEA_1_P42 (SEQ ID NO:506)

According to preferred embodiments of the present invention, there is provided an isolated polynucleotide comprising a nucleic acid sequence in the table below and/or: TABLE-US-00053 Transcript Name HUMTREFAC_PEA_2_T4 (SEQ ID NO:507) HUMTREFAC_PEA_2_T5 (SEQ ID NO:508)

a nucleic acid sequence comprising a sequence in the table below: TABLE-US-00054 Segment Name HUMTREFAC_PEA_2_node_0 (SEQ ID NO:509) HUMTREFAC_PEA_2_node_9 (SEQ ID NO:510) HUMTREFAC_PEA_2_node_2 (SEQ ID NO:511) HUMTREFAC_PEA_2_node_3 (SEQ ID NO:512) HUMTREFAC_PEA_2_node_4 (SEQ ID NO:513) HUMTREFAC_PEA_2_node_5 (SEQ ID NO:514) HUMTREFAC_PEA_2_node_8 (SEQ ID NO:515)

According to preferred embodiments of the present invention, there is provided an isolated polypeptide comprising an amino acid sequence in the table below TABLE-US-00055 Protein Name HUMTREFAC_PEA_2_P7 (SEQ ID NO:517) HUMTREFAC_PEA_2_P8 (SEQ ID NO:518)

According to preferred embodiments of the present invention, there is provided an isolated polynucleotide comprising a nucleic acid sequence in the table below and/or: TABLE-US-00056 Transcript Name HUMOSTRO_PEA_1_PEA_1_T14 (SEQ ID NO:519) HUMOSTRO_PEA_1_PEA_1_T16 (SEQ ID NO:520) HUMOSTRO_PEA_1_PEA_1_T30 (SEQ ID NO:521)

a nucleic acid sequence comprising a sequence in the table below: TABLE-US-00057 Segment Name HUMOSTRO_PEA_1_PEA_1_node_0 (SEQ ID NO:522) HUMOSTRO_PEA_1_PEA_1_node_10 (SEQ ID NO:523) HUMOSTRO_PEA_1_PEA_1_node_16 (SEQ ID NO:524) HUMOSTRO_PEA_1_PEA_1_node_23 (SEQ ID NO:525) HUMOSTRO_PEA_1_PEA_1_node_31 (SEQ ID NO:526) HUMOSTRO_PEA_1_PEA_1_node_43 (SEQ ID NO:527) HUMOSTRO_PEA_1_PEA_1_node_3 (SEQ ID NO:528) HUMOSTRO_PEA_1_PEA_1_node_5 (SEQ ID NO:529) HUMOSTRO_PEA_1_PEA_1_node_7 (SEQ ID NO:530) HUMOSTRO_PEA_1_PEA_1_node_8 (SEQ ID NO:531) HUMOSTRO_PEA_1_PEA_1_node_15 (SEQ ID NO:532) HUMOSTRO_PEA_1_PEA_1_node_17 (SEQ ID NO:533) HUMOSTRO_PEA_1_PEA_1_node_20 (SEQ ID NO:534) HUMOSTRO_PEA_1_PEA_1_node_21 (SEQ ID NO:535) HUMOSTRO_PEA_1_PEA_1_node_22 (SEQ ID NO:536) HUMOSTRO_PEA_1_PEA_1_node_24 (SEQ ID NO:537) HUMOSTRO_PEA_1_PEA_1_node_26 (SEQ ID NO:538) HUMOSTRO_PEA_1_PEA_1_node_27 (SEQ ID NO:539) HUMOSTRO_PEA_1_PEA_1_node_28 (SEQ ID NO:540) HUMOSTRO_PEA_1_PEA_1_node_29 (SEQ ID NO:541) HUMOSTRO_PEA_1_PEA_1_node_30 (SEQ ID NO:542) HUMOSTRO_PEA_1_PEA_1_node_32 (SEQ ID NO:543) HUMOSTRO_PEA_1_PEA_1_node_34 (SEQ ID NO:544) HUMOSTRO_PEA_1_PEA_1_node_36 (SEQ ID NO:545) HUMOSTRO_PEA_1_PEA_1_node_37 (SEQ ID NO:546) HUMOSTRO_PEA_1_PEA_1_node_38 (SEQ ID NO:547) HUMOSTRO_PEA_1_PEA_1_node_39 (SEQ ID NO:548) HUMOSTRO_PEA_1_PEA_1_node_40 (SEQ ID NO:549) HUMOSTRO_PEA_1_PEA_1_node_41 (SEQ ID NO:550) HUMOSTRO_PEA_1_PEA_1_node_42 (SEQ ID NO:551)

According to preferred embodiments of the present invention, there is provided an isolated polypeptide comprising an amino acid sequence in the table below TABLE-US-00058 Protein Name HUMOSTRO_PEA_1_PEA_1_P21 (SEQ ID NO:553) HUMOSTRO_PEA_1_PEA_1_P25 (SEQ ID NO:554) HUMOSTRO_PEA_1_PEA_1_P30 (SEQ ID NO:555)

According to preferred embodiments of the present invention, there is provided an isolated polynucleotide comprising a polynucleotide having a sequence selected from the group consisting of: R11723_PEA.sub.--1_T15 (SEQ ID NO:556), R11723_PEA.sub.--1_T17 (SEQ ID NO:557), R11723_PEA.sub.--1_T19 (SEQ ID NO:558), R11723_PEA.sub.--1_T20 (SEQ ID NO:559), R11723_PEA.sub.--1_T5 (SEQ ID NO:560), or R11723_PEA.sub.--1_T6 (SEQ ID NO:561).

According to preferred embodiments of the present invention, there is provided an isolated polynucleotide comprising a node having a sequence selected from the group consisting of: R11723_PEA.sub.--1_node.sub.--13 (SEQ ID NO:562), R11723_PEA.sub.--1_node.sub.--16 (SEQ ID NO:563), R11723_PEA.sub.--1_node.sub.--19 (SEQ ID NO:564), R11723_PEA.sub.--1_node.sub.--2 (SEQ ID NO:565), R11723_PEA.sub.--1_node.sub.--22 (SEQ ID NO:566), R11723_PEA.sub.--1_node.sub.--31 (SEQ ID NO:567), R11723_PEA.sub.--1_node.sub.--10 (SEQ ID NO:568), R11723_PEA.sub.--1_node.sub.--11 (SEQ ID NO:569), R11723_PEA.sub.--1_node.sub.--15 (SEQ ID NO:570), R11723_PEA.sub.--1_node.sub.--18 (SEQ ID NO:571), R11723_PEA.sub.--1_node.sub.--20 (SEQ ID NO:572), R11723_PEA.sub.--1_node.sub.--21 (SEQ ID NO:573), R11723_PEA.sub.--1_node.sub.--23 (SEQ ID NO:574), R11723_PEA.sub.--1_node.sub.--24 (SEQ ID NO:575), R11723_PEA.sub.--1_node.sub.--25 (SEQ ID NO:576), R11723_PEA.sub.--1_node.sub.--26 (SEQ ID NO:577), R11723_PEA.sub.--1_node.sub.--27 (SEQ ID NO:578), R11723_PEA.sub.--1_node.sub.--28 (SEQ ID NO:579), R11723_PEA.sub.--1_node.sub.--29 (SEQ ID NO:580), R11723_PEA.sub.--1_node.sub.--3 (SEQ ID NO:581), R11723_PEA.sub.--1_node.sub.--30 (SEQ ID NO:582), R11723_PEA.sub.--1_node.sub.--4 (SEQ ID NO:583), R11723_PEA.sub.--1_node.sub.--5 (SEQ ID NO:584), R11723_PEA.sub.--1_node.sub.--6 (SEQ ID NO:585), R11723_PEA.sub.--1_node.sub.--7 (SEQ ID NO:586) or R11723_PEA.sub.--1_node.sub.--8 (SEQ ID NO:587).

According to preferred embodiments of the present invention, there is provided an isolated polypeptide comprising a polypeptide having a sequence selected from the group consisting of: R11723_PEA.sub.--1.sub.13 P2 (SEQ ID NO:588), R11723_PEA.sub.--1_P6 (SEQ ID NO:589), R11723_PEA.sub.--1_P7 (SEQ ID NO:590), R11723_PEA.sub.--1_P13 (SEQ ID NO:591), or R11723_PEA.sub.--1_P10 (SEQ ID NO:592).

According to preferred embodiments of the present invention, there is provided an isolated polynucleotide comprising a nucleic acid sequence in the table below and/or: TABLE-US-00059 Transcript Name T46984_PEA_1_T2 (SEQ ID NO: 593) T46984_PEA_1_T3 (SEQ ID NO: 594) T46984_PEA_1_T12 (SEQ ID NO: 595) T46984_PEA_1_T13 (SEQ ID NO: 596) T46984_PEA_1_T14 (SEQ ID NO: 597) T46984_PEA_1_T15 (SEQ ID NO: 598) T46984_PEA_1_T19 (SEQ ID NO: 599) T46984_PEA_1_T23 (SEQ ID NO: 600) T46984_PEA_1_T27 (SEQ ID NO: 601) T46984_PEA_1_T32 (SEQ ID NO: 602) T46984_PEA_1_T34 (SEQ ID NO: 603) T46984_PEA_1_T35 (SEQ ID NO: 604) T46984_PEA_1_T40 (SEQ ID NO: 605) T46984_PEA_1_T42 (SEQ ID NO: 606) T46984_PEA_1_T43 (SEQ ID NO: 607) T46984_PEA_1_T46 (SEQ ID NO: 608) T46984_PEA_1_T47 (SEQ ID NO: 609) T46984_PEA_1_T48 (SEQ ID NO: 610) T46984_PEA_1_T51 (SEQ ID NO: 611) T46984_PEA_1_T52 (SEQ ID NO: 612) T46984_PEA_1_T54 (SEQ ID NO: 613)

a nucleic acid sequence comprising a sequence in the table below: TABLE-US-00060 Segment Name T46984_PEA_1_node_2 (SEQ ID NO: 614) T46984_PEA_1_node_4 (SEQ ID NO: 615) T46984_PEA_1_node_6 (SEQ ID NO: 616) T46984_PEA_1_node_12 (SEQ ID NO: 617) T46984_PEA_1_node_14 (SEQ ID NO: 618) T46984_PEA_1_node25 (SEQ ID NO: 619) T46984_PEA_1_node_29 (SEQ ID NO: 620) T46984_PEA_1_node_34 (SEQ ID NO: 621) T46984_PEA_1_node_46 (SEQ ID NO: 622) T46984_PEA_1_node_47 (SEQ ID NO: 623) T46984_PEA_1_node_52 (SEQ ID NO: 624) T46984_PEA_1_node_65 (SEQ ID NO: 625) T46984_PEA_1_node_69 (SEQ ID NO: 626) T46984_PEA_1_node_75 (SEQ ID NO: 627) T46984_PEA_1_node_86 (SEQ ID NO: 628) T46984_PEA_1_node_9 (SEQ ID NO: 629) T46984_PEA_1_node_13 (SEQ ID NO: 630) T46984_PEA_1_node_19 (SEQ ID NO: 631) T46984_PEA_1_node_21 (SEQ ID NO: 632) T46984_PEA_1_node_22 (SEQ ID NO: 633) T46984_PEA_1_node_26 (SEQ ID NO: 634) T46984_PEA_1_node_28 (SEQ ID NO: 635) T46984_PEA_1_node_31 (SEQ ID NO: 636) T46984_PEA_1_node_32 (SEQ ID NO: 637) T46984_PEA_1_node_38 (SEQ ID NO: 638) T46984_PEA_1_node_39 (SEQ ID NO: 639) T46984_PEA_1_node_40 (SEQ ID NO: 640) T46984_PEA_1_node_42 (SEQ ID NO: 641) T46984_PEA_1_node_43 (SEQ ID NO: 642) T46984_PEA_1_node_48 (SEQ ID NO: 643) T46984_PEA_1_node_49 (SEQ ID NO: 644) T46984_PEA_1_node_50 (SEQ ID NO: 645) T46984_PEA_1_node_51 (SEQ ID NO: 646) T46984_PEA_1_node_53 (SEQ ID NO: 647) T46984_PEA_1_node_54 (SEQ ID NO: 648) T46984_PEA_1_node_55 (SEQ ID NO: 649) T46984_PEA_1_node_57 (SEQ ID NO: 650) T46984_PEA_1_node_60 (SEQ ID NO: 651) T46984_PEA_node_62 (SEQ ID NO: 652) T46984_PEA_1_node_66 (SEQ ID NO: 653) T46984_PEA_1_node_67 (SEQ ID NO: 654) T46984_PEA_1_node_70 (SEQ ID NO: 655) T46984_PEA_1_node_71 (SEQ ID NO: 656) T46984_PEA_1_node_72 (SEQ ID NO: 657) T46984_PEA_1_node_73 (SEQ ID NO: 658) T46984_PEA_1_node_74 (SEQ ID NO: 659) T46984_PEA_1_node_83 (SEQ ID NO: 660) T46984_PEA_1_node_84 (SEQ ID NO: 661) T46984_PEA_1_node_85 (SEQ ID NO: 662)

According to preferred embodiments of the present invention, there is provided an isolated polypeptide comprising an amino acid sequence in the table below TABLE-US-00061 Protein Name T46984_PEA_1_P2 (SEQ ID NO: 664) T46984_PEA_1_P3 (SEQ ID NO: 665) T46984_PEA_1_P10 (SEQ ID NO: 666) T46984_PEA_1_P11 (SEQ ID NO: 667) T46984_PEA_1_P12 (SEQ ID NO: 668) T46984_PEA_1_P21 (SEQ ID NO: 669) T46984_PEA_1_P27 (SEQ ID NO: 670) T46984_PEA_1_P32 (SEQ ID NO: 671) T46984_PEA_1_P34 (SEQ ID NO: 672) T46984_PEA_1_P35 (SEQ ID NO: 673) T46984_PEA_1_P38 (SEQ ID NO: 674) T46984_PEA_1_P39 (SEQ ID NO: 675) T46984_PEA_1_P45 (SEQ ID NO: 676) T46984_PEA_1_P46 (SEQ ID NO: 677)

According to preferred embodiments of the present invention, there is provided an isolated polynucleotide comprising a nucleic acid sequence in the table below and/or: TABLE-US-00062 Transcript Name T11628_PEA_1_T3 (SEQ ID NO: 678) T11628_PEA_1_T4 (SEQ ID NO: 679) T11628_PEA_1_T5 (SEQ ID NO: 680) T11628_PEA_1_T7 (SEQ ID NO: 681) T11628_PEA_1_T9 (SEQ ID NO: 682) T11628_PEA_1_T11 (SEQ ID NO: 683)

a nucleic acid sequence comprising a sequence in the table below: TABLE-US-00063 Segment Name T11628_PEA_1_node_7 (SEQ ID NO: 684) T11628_PEA_1_node_11 (SEQ ID NO: 685) T11628_PEA_1_node_16 (SEQ ID NO: 686) T11628_PEA_1_node_22 (SEQ ID NO: 687) T11628_PEA_1_node_25 (SEQ ID NO: 688) T11628_PEA_1_node_31 (SEQ ID NO: 689) T11628_PEA_1_node_37 (SEQ ID NO: 690) T11628_PEA_1_node_0 (SEQ ID NO: 691) T11628_PEA_1_node_4 (SEQ ID NO: 692) T11628_PEA_1_node_9 (SEQ ID NO: 693) T11628_PEA_1_node_13 (SEQ ID NO: 694) T11628_PEA_1_node_14 (SEQ ID NO: 695) T11628_PEA_1_node_17 (SEQ ID NO: 696) T11628_PEA_1_node_18 (SEQ ID NO: 697) T11628_PEA_1_node_19 (SEQ ID NO: 698) T11628_PEA_1_node_24 (SEQ ID NO: 699) T11628_PEA_1_node_27 (SEQ ID NO: 700) T11628_PEA_1_node_28 (SEQ ID NO: 701) T11628_PEA_1_node_29 (SEQ ID NO: 702) T11628_PEA_1_node_30 (SEQ ID NO: 703) T11628_PEA_1_node_32 (SEQ ID NO: 704) T11628_PEA_1_node_33 (SEQ ID NO: 705) T11628_PEA_1_node_34 (SEQ ID NO: 706) T11628_PEA_1_node_35 (SEQ ID NO: 707) T11628_PEA_1_node_36 (SEQ ID NO: 708)

According to preferred embodiments of the present invention, there is provided an isolated polypeptide comprising an amino acid sequence in the table below TABLE-US-00064 Protein Name T11628_PEA_1_P2 (SEQ ID NO: 712) T11628_PEA_1_P5 (SEQ ID NO: 713) T11628_PEA_1_P7 (SEQ ID NO: 714) T11628_PEA_1_P10 (SEQ ID NO: 715)

According to preferred embodiments of the present invention, there is provided an isolated polynucleotide comprising a nucleic acid sequence in the table below and/or: TABLE-US-00065 Transcript Name M78076_PEA_1_T2 (SEQ ID NO: 716) M78076_PEA_1_T3 (SEQ ID NO: 717) M78076_PEA_1_T5 (SEQ ID NO: 718) M78076_PEA_1_T13 (SEQ ID NO: 719) M78076_PEA_1_T15 (SEQ ID NO: 720) M78076_PEA_1_T23 (SEQ ID NO: 721) M78076_PEA_1_T26 (SEQ ID NO: 722) M78076_PEA_1_T27 (SEQ ID NO: 723) M78076_PEA_1_T28 (SEQ ID NO: 724)

a nucleic acid sequence comprising a sequence in the table below: TABLE-US-00066 Segment Name M78076_PEA_1_node_0 (SEQ ID NO: 725) M78076_PEA_1_node_10 (SEQ ID NO: 726) M78076_PEA_1_node_15 (SEQ ID NO: 727) M78076_PEA_1_node_18 (SEQ ID NO: 728) M78076_PEA_1_node_20 (SEQ ID NO: 729) M78076_PEA_1_node_24 (SEQ ID NO: 730) M78076_PEA_1_node_26 (SEQ ID NO: 731) M78076_PEA_1_node_29 (SEQ ID NO: 732) M78076_PEA_1_node_32 (SEQ ID NO: 733) M78076_PEA_1_node_35 (SEQ ID NO: 734) M78076_PEA_1_node_37 (SEQ ID NO: 735) M78076_PEA_1_node_46 (SEQ ID NO: 736) M78076_PEA_1_node_47 (SEQ ID NO: 737) M78076_PEA_1_node_54 (SEQ ID NO: 738) M78076_PEA_1_node_1 (SEQ ID NO: 739) M78076_PEA_1_node_2 (SEQ ID NO: 740) M78076_PEA_1_node_3 (SEQ ID NO: 741) M78076_PEA_1_node_6 (SEQ ID NO: 742) M78076_PEA_1_node_7 (SEQ ID NO: 743) M78076_PEA_1_node_12 (SEQ ID NO: 744) M78076_PEA_1_node_22 (SEQ ID NO: 745) M78076_PEA_1_node_27 (SEQ ID NO: 746) M78076_PEA_1_node_30 (SEQ ID NO: 747) M78076_PEA_1_node_31 (SEQ ID NO: 748) M78076_PEA_1_node_34 (SEQ ID NO: 749) M78076_PEA_1_node_36 (SEQ ID NO: 750) M78076_PEA_1_node_41 (SEQ ID NO: 751) M78076_PEA_1_node_42 (SEQ ID NO: 752) M78076_PEA_1_node_43 (SEQ ID NO: 753) M78076_PEA_1_node_45 (SEQ ID NO: 754) M78076_PEA_1_node_49 (SEQ ID NO: 755) M78076_PEA_1_node_50 (SEQ ID NO: 756) M78076_PEA_1_node_51 (SEQ ID NO: 757) M78076_PEA_1_node_52 (SEQ ID NO: 758) M78076_PEA_1_node_53 (SEQ ID NO: 759)

According to preferred embodiments of the present invention, there is provided an isolated polypeptide comprising an amino acid sequence in the table below TABLE-US-00067 Protein Name M78076_PEA_1_P3 (SEQ ID NO: 761) M78076_PEA_1_P4 (SEQ ID NO: 762) M78076_PEA_1_P12 (SEQ ID NO: 763) M78076_PEA_1_P14 (SEQ ID NO: 764) M78076_PEA_1_P21 (SEQ ID NO: 765) M78076_PEA_1_P24 (SEQ ID NO: 766) M78076_PEA_1_P2 (SEQ ID NO: 767) M78076_PEA_1_P25 (SEQ ID NO: 768)

According to preferred embodiments of the present invention, there is provided an isolated polynucleotide comprising a nucleic acid sequence in the table below and/or: TABLE-US-00068 Transcript Name HSMUC1A_PEA_1_T12 (SEQ ID NO:769) HSMUC1A_PEA_1_T26 (SEQ ID NO:770) HSMUC1A_PEA_1_T28 (SEQ ID NO:771) HSMUC1A_PEA_1_T29 (SEQ ID NO:772) HSMUC1A_PEA_1_T30 (SEQ ID NO:773) HSMUC1A_PEA_1_T31 (SEQ ID NO:774) HSMUC1A_PEA_1_T33 (SEQ ID NO:775) HSMUC1A_PEA_1_T34 (SEQ ID NO:776) HSMUC1A_PEA_1_T35 (SEQ ID NO:777) HSMUC1A_PEA_1_T36 (SEQ ID NO:778) HSMUC1A_PEA_1_T40 (SEQ ID NO:779) HSMUC1A_PEA_1_T42 (SEQ ID NO:780) HSMUC1A_PEA_1_T43 (SEQ ID NO:781) HSMUC1A_PEA_1_T47 (SEQ ID NO:782)

a nucleic acid sequence comprising a sequence in the table below: TABLE-US-00069 Segment Name HSMUC1A_PEA_1_node_0 (SEQ ID NO:783) HSMUC1A_PEA_1_node_14 (SEQ ID NO:784) HSMUC1A_PEA_1_node_24 (SEQ ID NO:785) HSMUC1A_PEA_1_node_29 (SEQ ID NO:786) HSMUC1A_PEA_1_node_35 (SEQ ID NO:787) HSMUC1A_PEA_1_node_38 (SEQ ID NO:788) HSMUC1A_PEA_1_node_3 (SEQ ID NO:789) HSMUC1A_PEA_1_node_4 (SEQ ID NO:790) HSMUC1A_PEA_1_node_5 (SEQ ID NO:791) HSMUC1A_PEA_1_node_6 (SEQ ID NO:792) HSMUC1A_PEA_1_node_7 (SEQ ID NO:793) HSMUC1A_PEA_1_node_17 (SEQ ID NO:794) HSMUC1A_PEA_1_node_18 (SEQ ID NO:795) HSMUC1A_PEA_1_node_20 (SEQ ID NO:796) HSMUC1A_PEA_1_node_21 (SEQ ID NO:797) HSMUC1A_PEA_1_node_23 (SEQ ID NO:798) HSMUC1A_PEA_1_node_26 (SEQ ID NO:799)

HSMUC1A_PEA_1_node_27 (SEQ ID NO:800)
HSMUC1A_PEA_1_node_31 (SEQ ID NO:801)
HSMUC1A_PEA_1_node_34 (SEQ ID NO:802)
HSMUC1A_PEA_1_node_36 (SEQ ID NO:803)
HSMUC1A_PEA_1_node_37 (SEQ ID NO:804)

According to preferred embodiments of the present invention, there is provided an isolated polypeptide comprising an amino acid sequence in the table below TABLE-US-00070 Protein Name HSMUC1A_PEA_1_P25 (SEQ ID NO:806)
HSMUC1A_PEA_1_P29 (SEQ ID NO:807)
HSMUC1A_PEA_1_P30 (SEQ ID NO:808)
HSMUC1A_PEA_1_P32 (SEQ ID NO:809)
HSMUC1A_PEA_1_P36 (SEQ ID NO:810)
HSMUC1A_PEA_1_P39 (SEQ ID NO:811)
HSMUC1A_PEA_1_P45 (SEQ ID NO:812)
HSMUC1A_PEA_1_P49 (SEQ ID NO:813)
HSMUC1A_PEA_1_P52 (SEQ ID NO:814)
HSMUC1A_PEA_1_P53 (SEQ ID NO:815)
HSMUC1A_PEA_1_P56 (SEQ ID NO:816)
HSMUC1A_PEA_1_P58 (SEQ ID NO:817)
HSMUC1A_PEA_1_P59 (SEQ ID NO:818)
HSMUC1A_PEA_1_P63 (SEQ ID NO:819)

According to preferred embodiments of the present invention, there is provided an isolated chimeric polypeptide encoding for HSMUC1A_PEA.sub.--1_P63 (SEQ ID NO:819), comprising a first amino acid sequence being at least 90% homologous to MTPGTQSPFFLLLLLTVLTV-VTGSGHASSTPGGEKETSATQRSSV corresponding to amino acids 1-45 of MUC1_HUMAN (SEQ ID NO:805), which also corresponds to amino acids 1-45 of HSMUC1A_PEA.sub.--1_P63 (SEQ ID NO:819), and a second amino acid sequence being at least 70%, optionally at least 80%, preferably at least 85%, more preferably at least 90% and most preferably at least 95% homologous to a polypeptide having the sequence EEEVSADQVSVGASGV-LGSFKEARNAPSFLSWSFSMGPSK (SEQ ID NO:946) corresponding to amino acids 46-85 of HSMUC1A_PEA.sub.--1_P63 (SEQ ID NO:819), wherein said first amino acid sequence and second amino acid sequence are contiguous and in a sequential order.

According to preferred embodiments of the present invention, there is provided an isolated polypeptide encoding for a tail of HSMUC1A_PEA.sub.--1_P63 (SEQ ID NO:819), comprising a polypeptide being at least 70%, optionally at least about 80%, preferably at least about 85%, more preferably at least about 90% and most preferably at least about 95% homologous to the sequence EEEVSADQVSVGAS-GVLGSFKEARNAPSFLSWSFSMGPSK (SEQ ID NO:946) in HSMUC1A_PEA.sub.--1_P63 (SEQ ID NO:819).

According to preferred embodiments of the present invention, there is provided an isolated chimeric polypeptide encoding for T46984_PEA.sub.--1_P2 (SEQ ID NO:664), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYMQASQALSGCEISISNETKDLLLMVSEDSS VTQIYHAVMLSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFAL FFQLVDVNTGAELTPHQTFVRLHNQKT-GQEVVFVAEPDNKNVYKFELDTSERKIEFDS ASG-TYTLYLIIGDATLKNPILWNV corresponding to amino acids 1-498 of RIB2_HUMAN (SEQ ID NO:663), which also corresponds to amino acids 1-498 of T46984_PEA.sub.--1_P2 (SEQ ID NO:664), and a second amino acid sequence being at least 70%, optionally at least 80%, preferably at least 85%, more preferably at least 90% and most preferably at least 95% homologous to a polypeptide having the sequence VCA corresponding to amino acids 499-501 of T46984_PEA.sub.--1_P2 (SEQ ID NO:664), wherein said first amino acid sequence and second amino acid sequence are contiguous and in a sequential order.

According to preferred embodiments of the present invention, there is provided an isolated chimeric polypeptide encoding for T46984_PEA.sub.--1_P3 (SEQ ID NO:665), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFAL FFQLVDVNTGAELTPHQ corresponding to amino acids 1-433 of RIB2_HUMAN (SEQ ID NO:663), which also corresponds to amino acids 1-433 of T46984_PEA.sub.--1P3 (SEQ ID NO:665), and a second amino acid sequence being at least 70%, optionally at least 80%, preferably at least 85%, more preferably at least 90% and most preferably at least 95% homologous to a polypeptide having the sequence ICHIWK-LIFLP (SEQ ID NO:947) corresponding to amino acids 434-444 of T46984_PEA.sub.--1_P3 (SEQ ID NO:665), wherein said first amino acid sequence and second amino acid sequence are contiguous and in a sequential order.

According to preferred embodiments of the present invention, there is provided an isolated polypeptide encoding for a tail of T46984_PEA.sub.--1_P3 (SEQ ID NO:665), comprising a polypeptide being at least 70%, optionally at least about 80%, preferably at least about 85%, more preferably at least about 90% and most preferably at least about 95% homologous to the sequence ICHIWKLIFLP (SEQ ID NO:947) in T46984_PEA.sub.--1_P3 (SEQ ID NO:665).

According to preferred embodiments of the present invention, there is provided an isolated chimeric polypeptide encoding for T46984_PEA.sub.--1_P10 (SEQ ID NO:666), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVMLSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAMVLSHNRYH-VPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-
KDQSIAPKTTRVTYPAKAKGTFIADSHQNFAL
FFQLVDVNTGAELTPHQTFVRLHNQKT-
GQEVVFVAEPDNKNVYKFELDTSERKIEFDS ASG-
TYTLYLIIGDATLKNPILWNV corresponding to amino acids 1-498 of RIB2_HUMAN (SEQ ID NO:663), which also corresponds to amino acids 1-498 of T46984_PEA.sub.--1_P10 (SEQ ID NO:666), and a second amino acid sequence being at least 70%, optionally at least 80%, preferably at least 85%, more preferably at least 90% and most preferably at least 95% homologous to a polypeptide having the sequence LMDQK (SEQ ID NO:948) corresponding to amino acids 499-503 of T46984_PEA.sub.--1_P10 (SEQ ID NO:666), wherein said first amino acid sequence and second amino acid sequence are contiguous and in a sequential order.

According to preferred embodiments of the present invention, there is provided an isolated polypeptide encoding for a tail of T46984_PEA.sub.--1_P10 (SEQ ID NO:666), comprising a polypeptide being at least 70%, optionally at least about 80%, preferably at least about 85%, more preferably at least about 90% and most preferably at least about 95% homologous to the sequence LMDQK (SEQ ID NO:948) in T46984_PEA.sub.--1_P10 (SEQ ID NO:666).

According to preferred embodiments of the present invention, there is provided an isolated chimeric polypeptide encoding for T46984_PEA.sub.--1_P11 (SEQ ID NO:667), comprising a first amino acid sequence being at least 90% homologous to MAPPGSSTVFLLALTIIASTWALTPTH-
YLTKHDVERLKASLDRPFTNLESAFYSIVGLSSL
GAQVPDAKKACTYIRSNLDPSNVD-
SLFYMQASQALSGCEISISNETKDLLLMVSEDSS
VTQIYHAVMLSGFGLPLASQEALSAL-
TARLSKEETVLATVQALQTASHLSQQADLRSI VEE-
IEDLVARLDELGGVYLQFEEGLET-
TALFVMTYKLMDHVGTEPSIKEDQVIQLMNA
IFSKKNFESLSEAFSVASAAAVLSHNRY-
HVPVVVVPEGSASDTHEQAILRLQVTNVLSQ
PLTQATVKLEHAKSVASRATVLQKTSFT-
PVGDVFELNFMNVKFSSGYYDFLVEVEGDN
RYIANTVELRVKISTEVGITNVDLSTVD-
KDQSIAPKTTRVTYPAKAKGTFIADSHQNFAL
FFQLVDVNTGAELTPHQTFVRLHNQKT-
GQEVVFVAEPDNKNVYKFELDTSERKIEFDS ASG-
TYTLYLIIGDATLKNPILWNVADVVIKF-
PEEEAPSTVLSQNLFTPKQEIQHLFREPEK
RPPTVVSNTFTALILSPLLLLFAL-
WIRIGANVSNFTFAPSTIIFHLGHAAMLGLMYVYWT
QLNMFQTLKYLAILGSVTFLAGNRMLAQQAVKR corresponding to amino acids 1-628 of RIB2_HUMAN (SEQ ID NO:663), which also corresponds to amino acids 1-628 of T46984_PEA.sub.--1_P11 (SEQ ID NO:667).

According to preferred embodiments of the present invention, there is provided an isolated chimeric polypeptide encoding for T46984_PEA.sub.--1_P12 (SEQ ID NO:668), comprising a first amino acid sequence being at least 90% homologous to MAPPGSSTVFLLALTIIASTWALTPTH-
YLTKHDVERLKASLDRPFTNLESAFYSIVGLSSL
GAQVPDAKKACTYIRSNLDPSNVD-
SLFYAAQASQALSGCEISISNETKDLLLAAVSEDSS
VTQIYHAVMLSGFGLPLASQEALSAL-
TARLSKEETVLATVQALQTASHLSQQADLRSI VEE-
IEDLVARLDELGGVYLQFEEGLET-
TALFVMTYKLMDHVGTEPSIKEDQVIQLMNA
IFSKKNFESLSEAFSVASAAAVLSHNRY-
HVPVVVVPEGSASDTHEQAILRLQVTNVLSQ
PLTQATVKLEHAKSVASRATVLQKTSFT-
PVGDVFELNFMN corresponding to amino acids 1-338 of RIB2_HUMAN (SEQ ID NO:663), which also corresponds to amino acids 1-338 of T46984_PEA.sub.--1_P12 (SEQ ID NO:668), and a second amino acid sequence being at least 70%, optionally at least 80%, preferably at least 85%, more preferably at least 90% and most preferably at least 95% homologous to a polypeptide having the sequence SQDLH (SEQ ID NO:949) corresponding to amino acids 339-343 of T46984_PEA.sub.--1_P12 (SEQ ID NO:668), wherein said first amino acid sequence and second amino acid sequence are contiguous and in a sequential order.

According to preferred embodiments of the present invention, there is provided an isolated polypeptide encoding for a tail of T46984_PEA.sub.--1_P12 (SEQ ID NO:668), comprising a polypeptide being at least 70%, optionally at least about 80%, preferably at least about 85%, more preferably at least about 90% and most preferably at least about 95% homologous to the sequence SQDLH (SEQ ID NO:949) in T46984_PEA.sub.--1_P12 (SEQ ID NO:668).

According to preferred embodiments of the present invention, there is provided an isolated chimeric polypeptide encoding for T46984_PEA.sub.--1_P21 (SEQ ID NO:669), comprising a first amino acid sequence being at least 70%, optionally at least 80%, preferably at least 85%, more preferably at least 90% and most preferably at least 95% homologous to a polypeptide having the sequence M corresponding to amino acids 1-1 of T46984_PEA.sub.--1_P21 (SEQ ID NO:669), and a second amino acid sequence being at least 90% homologous to KACTYIRSNLDPSNVDSLFYM-
QASQALSGCEISISNETKDLLLMVSEDSSVTQIYHAV
MLSGFGLPLASQEALSALTARLSKEETV-
LATVQALQTASHLSQQADLRSIVEEIEDLVA RLDELG-
GVYLQFEEGLETTALFVMTYKLMDH-
VGTEPSIKEDQVIQLMNAIFSKKNFES
LSEAFSVASAAAVLSHNRYHVPVVVPEG-
SASDTHEQAILRLQVTNVLSQPLTQATVKL EHAKS-
VASRATVLQKTSFTPVGDVFELNFMN-
VKFSSGYYDFLVEVEGDNRYIANTVEL
RVKISTEVGITNVDLSTVDKDQSIAPKT-
TRVTYPAKAKGTFIADSHQNFALFFQLVDVNT
GAELTPHQTFVRLHNQKTGQEVVFVAEP-
DNKNVYKFELDTSERKIEFDSASGTYTLYLII
GDATLKNPILWNVADVVIKFPEEEAP-
STVLSQNLFTPKQEIQHLFREPEKRPPTVVSNTF
TALILSPLLLLFALWIRIGANVSNFT-
FAPSTIIFHLGHMMLGLMYVYWTQLNMFQTLKY
LAILGSVTFLAGNRMLAQQAVKRTAH corresponding to amino acids 70-631 of RIB2_HUMAN (SEQ ID NO:663), which also corresponds to amino acids 2-563 of T46984_PEA.sub.--1_P21 (SEQ ID NO:669), wherein said first amino acid sequence and second amino acid sequence are contiguous and in a sequential order.

According to preferred embodiments of the present invention, there is provided an isolated chimeric polypeptide encoding for T46984_PEA.sub.--1_P27 (SEQ ID NO:670), comprising a first amino acid sequence being at least 90% homologous to MAPPGSSTVFLLALTIIASTWALTPTH-
YLTKHDVERLKASLDRPFTNLESAFYSIVGLSSL
GAQVPDAKKACTYIRSNLDPSNVD-
SLFYMQASQALSGCEISISNETKDLLLAAVSEDSS
VTQIYHAVMLSGFGLPLASQEALSAL-
TARLSKEETVLATVQALQTASHLSQQADLRSI VEE-
IEDLVARLDELGGVYLQFEEGLET-
TALFVMTYKLMDHVGTEPSIKEDQVIQLMNA
IFSKKNFESLSEAFSVASAAAVLSHNRY-
HVPVVVVPEGSASDTHEQAILRLQVTNVLSQ
PLTQATVKLEHAKSVASRATVLQKTSFT-
PVGDVFELNFMNVKFSSGYYDFLVEVEGDN RYIANTVELRVKISTEVGITNVDLSTVD-KDQSIAPKTTRVTYPAKAKGTFIADSHQNFA corresponding to amino acids 1-415 of RIB2_HUMAN (SEQ ID NO:663), which also corresponds to amino acids 1-415 of T46984_PEA.sub.--1.sub.P27 (SEQ ID NO:670), and a second amino acid sequence being at least 70%, optionally at least 80%, preferably at least 85%, more preferably at least 90% and most preferably at least 95% homologous to a polypeptide having the sequence FGSGLVPM-SPTSLLLLARLYFTWDMLLCWDSCMSTGLSSTCSRP (SEQ ID NO:950) corresponding to amino acids 416-459 of T46984_PEA.sub.--1_P27 (SEQ ID NO:670), wherein said first amino acid sequence and second amino acid sequence are contiguous and in a sequential order.

According to preferred embodiments of the present invention, there is provided an isolated polypeptide encoding for a tail of T46984_PEA.sub.--1_P27 (SEQ ID NO:670), comprising a polypeptide being at least 70%, optionally at least about 80%, preferably at least about 85%, more preferably at least about 90% and most preferably at least about 95% homologous to the sequence FGSGLVPMSPTSLLLLAR-LYFTWDMLLCWDSCMSTGLSSTCSRP (SEQ ID NO:950) in T46984_PEA.sub.--1_P27 (SEQ ID NO:670).

According to preferred embodiments of the present invention, there is provided an isolated chimeric polypeptide encoding for T46984_PEA.sub.--1_P32 (SEQ ID NO:671), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVMTYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVE corresponding to amino acids 1-364 of RIB2_HUMAN (SEQ ID NO:663), which also corresponds to amino acids 1-364 of T46984_PEA.sub.--1_P32 (SEQ ID NO:671), and a second amino acid sequence being at least 70%, optionally at least 80%, preferably at least 85%, more preferably at least 90% and most preferably at least 95% homologous to a polypeptide having the sequence GQVR-WLTPVIPALWEAKAGGSPEVRSSILAWPT (SEQ ID NO:951) corresponding to amino acids 365-397 of T46984_PEA.sub.--1_P32 (SEQ ID NO:671), wherein said first amino acid sequence and second amino acid sequence are contiguous and in a sequential order.

According to preferred embodiments of the present invention, there is provided an isolated polypeptide encoding for a tail of T46984_PEA.sub.--1_P32 (SEQ ID NO:671), comprising a polypeptide being at least 70%, optionally at least about 80%, preferably at least about 85%, more preferably at least about 90% and most preferably at least about 95% homologous to the sequence GQVRWLTPVIPALWEAK-AGGSPEVRSSILAWPT (SEQ ID NO:951) in T46984_PEA.sub.--1_P32 (SEQ ID NO:671).

According to preferred embodiments of the present invention, there is provided an isolated chimeric polypeptide encoding for T46984_PEA.sub.--1_P34 (SEQ ID NO:672), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYMQASQALSGCEISISNETKDLLLMVSEDSS VTQIYHAVMLSGFGLPLASQEALSAL-TARLSKEETVLATVQALQTASHLSQQADLRSI VEE-IEDLVARLDELGGVYLQFEEGLET-TALFVMTYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFTPVG corresponding to amino acids 1-329 of RIB2_HUMAN (SEQ ID NO:663), which also corresponds to amino acids 1-329 of T46984_PEA.sub.--1.sub.13 P34 (SEQ ID NO:672).

According to preferred embodiments of the present invention, there is provided an isolated chimeric polypeptide encoding for T46984_PEA.sub.--1_P35 (SEQ ID NO:673), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAI corresponding to amino acids 1-287 of RIB2_HUMAN (SEQ ID NO:663), which also corresponds to amino acids 1-287 of T46984_PEA.sub.--1_P35 (SEQ ID NO:673), and a second amino acid sequence being at least 70%, optionally at least 80%, preferably at least 85%, more preferably at least 90% and most preferably at least 95% homologous to a polypeptide having the sequence GCWPSRQSREQHISSRRKMEILKTEC-QEKESRTIHSMRRKMEKKNFI (SEQ ID NO:952) corresponding to amino acids 288-334 of T46984_PEA.sub.--1_P35 (SEQ ID NO:673), wherein said first amino acid sequence and second amino acid sequence are contiguous and in a sequential order.

According to preferred embodiments of the present invention, there is provided an isolated polypeptide encoding for a tail of T46984_PEA.sub.--1_P35 (SEQ ID NO:673), comprising a polypeptide being at least 70%, optionally at least about 80%, preferably at least about 85%, more preferably at least about 90% and most preferably at least about 95% homologous to the sequence GCWPSRQSREQHISSRRK-MEILKTECQEKESRTIHSMRRKMEKKNFI (SEQ ID NO:952) in T46984_PEA.sub.--1_P35 (SEQ ID NO:673).

According to preferred embodiments of the present invention, there is provided an isolated chimeric polypeptide encoding for T46984_PEA.sub.--1_P38 (SEQ ID NO:674), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEAL corresponding to amino acids 1-145 of RIB2_HUMAN (SEQ ID NO:663), which also corresponds to amino acids 1-145 of T46984_PEA.sub.--1_P38 (SEQ ID NO:674), and a second amino acid sequence being at least 70%, optionally at least 80%, preferably at least 85%, more preferably at least 90% and most preferably at least 95% homologous to a polypeptide having the sequence MDPDWCQCLQLHFCS (SEQ ID NO:953) corresponding to amino acids 146-160 of T46984_PEA.sub.--1_P38 (SEQ ID NO:674), wherein said first amino acid sequence and second amino acid sequence are contiguous and in a sequential order.

According to preferred embodiments of the present invention, there is provided an isolated polypeptide encoding for a tail of T46984_PEA.sub.--1_P38 (SEQ ID NO:674), comprising a polypeptide being at least 70%, optionally at least about 80%, preferably at least about 85%, more preferably at least about 90% and most preferably at least about 95% homologous to the sequence MDPDWCQCLQLHFCS (SEQ ID NO:953) in T46984_PEA.sub.--1_P38 (SEQ ID NO:674)

According to preferred embodiments of the present invention, there is provided an isolated chimeric polypeptide encoding for T46984_PEA.sub.--1_P39 (SEQ ID NO:675), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLA corresponding to amino acids 1-160 of RIB2_HUMAN (SEQ ID NO:663), which also corresponds to amino acids 1-160 of T46984_PEA.sub.--1_P39 (SEQ ID NO:675).

According to preferred embodiments of the present invention, there is provided an isolated chimeric polypeptide encoding for T46984_PEA.sub.--1_P45 (SEQ ID NO:676), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCE corresponding to amino acids 1-101 of RIB2_HUMAN (SEQ ID NO:663), which also corresponds to amino acids 1-101 of T46984_PEA.sub.--1_P45 (SEQ ID NO:676), and a second amino acid sequence being at least 70%, optionally at least 80%, preferably at least 85%, more preferably at least 90% and most preferably at least 95% homologous to a polypeptide having the sequence NSPG-SADSIPPVPAG (SEQ ID NO:954) corresponding to amino acids 102-116 of T46984_PEA.sub.--1_P45 (SEQ ID NO:676), wherein said first amino acid sequence and second amino acid sequence are contiguous and in a sequential order.

According to preferred embodiments of the present invention, there is provided an isolated polypeptide encoding for a tail of T46984_PEA.sub.--1_P45 (SEQ ID NO:676), comprising a polypeptide being at least 70%, optionally at least about 80%, preferably at least about 85%, more preferably at least about 90% and most preferably at least about 95% homologous to the sequence NSPGSADSIPPVPAG (SEQ ID NO:954) in T46984_PEA.sub.--1_P45 (SEQ ID NO:676).

According to preferred embodiments of the present invention, there is provided an isolated chimeric polypeptide encoding for T46984_PEA.sub.--1_P46 (SEQ ID NO:677), comprising a first amino acid sequence being at least 90% homologous to MAPPGSSTVFLLALTIIASTWALTPTH-YLTKHDVERLKASLDRPFTNLESAFYSIVGLSSL GAQVPDAK corresponding to amino acids 1-69 of RIB2_HUMAN (SEQ ID NO:663), which also corresponds to amino acids 1-69 of T46984_PEA.sub.--1_P46 (SEQ ID NO:677), and a second amino acid sequence being at least 70%, optionally at least 80%, preferably at least 85%, more preferably at least 90% and most preferably at least 95% homologous to a polypeptide having the sequence NSPG-SADSIPPVPAG (SEQ ID NO:954) corresponding to amino acids 70-84 of T46984_PEA.sub.--1_P46 (SEQ ID NO:677), wherein said first amino acid sequence and second amino acid sequence are contiguous and in a sequential order.

According to preferred embodiments of the present invention, there is provided an isolated polypeptide encoding for a tail of T46984_PEA.sub.--1_P46 (SEQ ID NO:677), comprising a polypeptide being at least 70%, optionally at least about 80%, preferably at least about 85%, more preferably at least about 90% and most preferably at least about 95% homologous to the sequence NSPGSADSIPPVPAG (SEQ ID NO:954) in T46984_PEA.sub.--1_P46 (SEQ ID NO:677).

According to preferred embodiments of the present invention, there is provided an isolated chimeric polypeptide encoding for T11628_PEA.sub.--1_P2 (SEQ ID NO:712), comprising a first amino acid sequence being at least 70%, optionally at least 80%, preferably at least 85%, more preferably at least 90% and most preferably at least 95% homologous to a polypeptide having the sequence MGLS-DGEWQLVLNVWGKVEADIPGHGQEVLIRLFKGHPE TLEKFDKFKHLKSEDE (SEQ ID NO:956) corresponding to amino acids 1-55 of T11628_PEA.sub.--1_P2 (SEQ ID NO:712), and a second amino acid sequence being at least 90% homologous to MKASEDLKKHGATVLTALG-GILKKKGHHEAEIKPLAQSHATKH-KIPVKYLEFISECIIQV LQSKHPGDFGADAQ-GAMNKALELFRKDMASNYKELGFQG corresponding to amino acids 1-99 of Q8WVH6 (SEQ ID NO:711), which also corresponds to amino acids 56-154 of T11628_PEA.sub.--1_P2 (SEQ ID NO:712), wherein said first amino acid sequence and second amino acid sequence are contiguous and in a sequential order.

According to preferred embodiments of the present invention, there is provided an isolated polypeptide encoding for a head of T11628_PEA.sub.--1_P2 (SEQ ID NO:712), comprising a polypeptide being at least 70%, optionally at least about 80%, preferably at least about 85%, more preferably at least about 90% and most preferably at least about 95% homologous to the sequence TABLE-US-00071 MGLS-DGEWQLVLNVWGKVEADIPGHGQEV-LIRLFKGHPETLEKFDKFKHLKSEDE (SEQ ID NO:956) of T11628_PEA__1_P2. (SEQ ID NO:712)

According to preferred embodiments of the present invention, there is provided an isolated chimeric polypeptide encoding for T11628_PEA.sub.--1_P5 (SEQ ID NO:713), comprising a first amino acid sequence being at least 90% homologous to MKASEDLKKHGATVLTALG-GILKKKGHHEAEIKPLAQSHATKH-KIPVKYLEFISECIIQV LQSKHPGDFGADAQ-GAMNKALELFRKDMASNYKELGFQG corresponding to amino acids 56-154 of MYG_HUMAN_V1 (SEQ ID NO:710), which also corresponds to amino acids 1-99 of T11628_PEA.sub.--1_P5 (SEQ ID NO:713).

According to preferred embodiments of the present invention, there is provided an isolated chimeric polypeptide encoding for T11628_PEA.sub.--1_P7 (SEQ ID NO:714), comprising a first amino acid sequence being at least 90% homologous to MGLSDGEWQLVLNVWGKVEADIPGH-GQEVLIRLFKGHPETLEKFDKFKHLKSEDEMK ASEDLKKHGATVLTALGGILKKKGHHE-AEIKPLAQSHATKHKIPVKYLEFISECIIQVLQ SKH-PGDFGADAQGAMNK corresponding to amino acids 1-134 of MYG_HUMAN_V1 (SEQ ID NO:710), which also corresponds to amino acids 1-134 of T11628_PEA.sub.--1_P7 (SEQ ID NO:714) and a second amino acid sequence being at least 70%, optionally at least 80%, preferably at least 85%, more preferably at least 90% and most preferably at least 95% homologous to a polypeptide having the sequence G corresponding to amino acids 135-135 of T11628_PEA.sub.--1_P7 (SEQ ID NO:714), wherein said first amino acid sequence and second amino acid sequence are contiguous and in a sequential order.

According to preferred embodiments of the present invention, there is provided an isolated chimeric polypeptide encoding for T11628_PEA.sub.--1_P10 (SEQ ID NO:715), comprising a first amino acid sequence being at least 70%, optionally at least 80%, preferably at least 85%, more preferably at least 90% and most preferably at least 95% homologous to a polypeptide having the sequence MGLSDGEWQLVLNVWGKVEADIPGHGQEVLIRLFKGHPE TLEKFDKFKHLKSEDE (SEQ ID NO:956) corresponding to amino acids 1-55 of T111628_PEA.sub.--1_P10 (SEQ ID NO:715), and a second amino acid sequence being at least 90% homologous to MKASEDLKKHGATVLTALGGILKKKGHHEAEIKPLAQSHATKH-KIPVKYLEFISECIIQV LQSKHPGDFGADAQ-GAMNKALELFRKDMASNYKELGFQG corresponding to amino acids 1-99 of Q8WVH6 (SEQ ID NO:711), which also corresponds to amino acids 56-154 of T11628_PEA.sub.--1_P10 (SEQ ID NO:715), wherein said first amino acid sequence and second amino acid sequence are contiguous and in a sequential order.

According to preferred embodiments of the present invention, there is provided an isolated polypeptide encoding for a head of T11628_PEA.sub.--1_P10 (SEQ ID NO:715), comprising a polypeptide being at least 70%, optionally at least about 80%, preferably at least about 85%, more preferably at least about 90% and most preferably at least about 95% homologous to the sequence MGLSDGEWQLVLN-VWGKVEADIPGHGQEVLIRLFKGH-PETLEKFDKFKHLKSEDE (SEQ ID NO:956) of T11628_PEA.sub.--1_P10 (SEQ ID NO:715).

According to preferred embodiments of the present invention, there is provided an isolated chimeric polypeptide encoding for M78076_PEA.sub.--1_P3 (SEQ ID NO:761), comprising a first amino acid sequence being at least 90% homologous to MGPASPAARGLSRRPGQPPLPLLL-PLLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQIQELLHSEHLGPSE-LEAPAPGGSSEDKGGLQPPDSKD corresponding to amino acids 1-517 of APP1_HUMAN (SEQ ID NO:760), which also corresponds to amino acids 1-517 of M78076_PEA.sub.--1_P3 (SEQ ID NO:761), and a second amino acid sequence being at least 70%, optionally at least 80%, preferably at least 85%, more preferably at least 90% and most preferably at least 95% homologous to a polypeptide having the sequence GE corresponding to amino acids 518-519 of M78076_PEA.sub.--1_P3 (SEQ ID NO:761), wherein said first amino acid sequence and second amino acid sequence are contiguous and in a sequential order.

According to preferred embodiments of the present invention, there is provided an isolated chimeric polypeptide encoding for M78076_PEA.sub.--1_P4 (SEQ ID NO:762), comprising a first amino acid sequence being at least 90% homologous to MGPASPAARGLSRRPGQPPLPLLL-PLLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQIQELLHSEHLGPSE-LEAPAPGGSSEDKGGLQPPDSKDDTPMTLPKG corresponding to amino acids 1-526 of APP1_HUMAN (SEQ ID NO:760), which also corresponds to amino acids 1-526 of M78076_PEA.sub.--1_P4 (SEQ ID NO:762), and a second amino acid sequence being at least 70%, optionally at least 80%, preferably at least 85%, more preferably at least 90% and most preferably at least 95% homologous to a polypeptide having the sequence ECLTVNPSLQIPLNP (SEQ ID NO:958) corresponding to amino acids 527-541 of M78076_PEA.sub.--1_P4 (SEQ ID NO:762), wherein said first amino acid sequence and second amino acid sequence are contiguous and in a sequential order.

According to preferred embodiments of the present invention, there is provided an isolated polypeptide encoding for a tail of M78076_PEA.sub.--1_P4 (SEQ ID NO:762), comprising a polypeptide being at least 70%, optionally at least about 80%, preferably at least about 85%, more preferably at least about 90% and most preferably at least about 95% homologous to the sequence ECLTVNPSLQIPLNP (SEQ ID NO:958) in M78076_PEA.sub.--1_P4 (SEQ ID NO:762).

According to preferred embodiments of the present invention, there is provided an isolated chimeric polypeptide encoding for M78076_PEA.sub.--1_P12 (SEQ ID NO:763), comprising a first amino acid sequence being at least 90% homologous to MGPASPAARGLSRRPGQPPLPLLL-PLLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQIQELLHSEHLGPSE-LEAPAPGGSSEDKGGLQPPDSKDDTPMTLPKG corresponding to amino acids 1-526 of APP1_HUMAN (SEQ ID NO:760), which also corresponds to amino acids 1-526 of M78076_PEA.sub.--1_P12 (SEQ ID NO:763), and a second amino acid sequence being at least 70%, optionally at least 80%, preferably at least 85%, more preferably at least 90% and most preferably at least 95% homologous to a polypeptide having the sequence ECVCSKGFPFPLIGDSEG (SEQ ID NO:959) corresponding to amino acids 527-544 of M78076_PEA.sub.--1_P12 (SEQ ID NO:763), wherein said first amino acid sequence and second amino acid sequence are contiguous and in a sequential order.

According to preferred embodiments of the present invention, there is provided an isolated polypeptide encoding for a tail of M78076_PEA.sub.--1_P12 (SEQ ID NO:763), comprising a polypeptide being at least 70%, optionally at least about 80%, preferably at least about 85%, more preferably at least about 90% and most preferably at least about 95% homologous to the sequence ECVCSKGFPFPLIGDSEG (SEQ ID NO:959) in M78076_PEA.sub.--1_P12 (SEQ ID NO:763).

According to preferred embodiments of the present invention, there is provided an isolated chimeric polypeptide encoding for M78076_PEA.sub.--1_P14 (SEQ ID NO:764), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQIQELLHSEHLGPSE-LEAPAPGGSSEDKGGLQPPDSKDDTPMTLPKGST EQDMSPEKEKMNPLEQYERKVNASVPRG-FPFHSSEIQRDEL corresponding to amino acids 1-570 of APP1_HUMAN (SEQ ID NO:760), which also corresponds to amino acids 1-570 of M78076_PEA.sub.--1_P14 (SEQ ID NO:764), and a second amino acid sequence being at least 70%, optionally at least 80%, preferably at least 85%, more preferably at least 90% and most preferably at least 95% homologous to a polypeptide having the sequence VRGG-TAGYLGEETRGQRPGCDSQSHTGPSKKP-SAPSPLPAGTSWDRGVP (SEQ ID NO:960) corresponding to amino acids 571-619 of M78076_PEA.sub.--1_P14 (SEQ ID NO:764), wherein said first amino acid sequence and second amino acid sequence are contiguous and in a sequential order.

According to preferred embodiments of the present invention, there is provided an isolated polypeptide encoding for a tail of M78076_PEA.sub.--1_P14 (SEQ ID NO:764), comprising a polypeptide being at least 70%, optionally at least about 80%, preferably at least about 85%, more preferably at least about 90% and most preferably at least about 95% homologous to the sequence VRGGTAGYLGEETRGQR-PGCDSQSHTGPSKKPSAPSPLPAGTSWDRGVP (SEQ ID NO:960) in M78076_PEA.sub.--1_P14 (SEQ ID NO:764).

According to preferred embodiments of the present invention, there is provided an isolated chimeric polypeptide encoding for M78076_PEA.sub.--1_P21 (SEQ ID NO:765), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALNE corresponding to amino acids 1-352 of APP1_HUMAN (SEQ ID NO:760), which also corresponds to amino acids 1-352 of M78076_PEA.sub.--1_P21 (SEQ ID NO:765), and a second amino acid sequence being at least 90% homologous to AERVLLALRRYLRAEQKEQRHTLRHYQH-VAAVDPEKAQQMRFQVHTHLQVIEERVNQ SLGLL-DQNPHLAQELRPQIQELLHSEHLGPSE-LEAPAPGGSSEDKGGLQPPDSKDDTPMT LPKGSTEQDMSPEKEKMNPLEQYERKV-NASVPRGFPFHSSEIQRDELAPAGTGVSREA VSGLLIMGAGGGSLIVLSMLLLR-RKKPYGAISHGWEVDPMLTLEEQQLRELQRHGYE NPTYRFLEERP corresponding to amino acids 406-650 of APP1_HUMAN (SEQ ID NO:760), which also corresponds to amino acids 353-597 of M78076_PEA.sub.--1_P21 (SEQ ID NO:765), wherein said first amino acid sequence and second amino acid sequence are contiguous and in a sequential order.

According to preferred embodiments of the present invention, there is provided an isolated chimeric polypeptide encoding for an edge portion of M78076_PEA.sub.--1_P21 (SEQ ID NO:765), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 352-x to 352; and ending at any of amino acid numbers 353+((n−2)-x), in which x varies from 0 to n−2.

According to preferred embodiments of the present invention, there is provided an isolated chimeric polypeptide encoding for M78076_PEA.sub.--1_P24 (SEQ ID NO:766), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQI corresponding to amino acids 1-481 of APP1_HUMAN (SEQ ID NO:760), which also corresponds to amino acids 1-481 of M78076_PEA.sub.--1_P24 (SEQ ID NO:766), and a second amino acid sequence being at least 70%, optionally at least 80%, preferably at least 85%, more preferably at least 90% and most preferably at least 95% homologous to a polypeptide having the sequence RECLL-PWLPLQISEGRS (SEQ ID NO:961) corresponding to amino acids 482-498 of M78076_PEA.sub.--1_P24 (SEQ ID NO:766), wherein said first amino acid sequence and second amino acid sequence are contiguous and in a sequential order.

According to preferred embodiments of the present invention, there is provided an isolated polypeptide encoding for a tail of M78076_PEA.sub.--1_P24 (SEQ ID NO:766), comprising a polypeptide being at least 70%, optionally at least about 80%, preferably at least about 85%, more preferably at least about 90% and most preferably at least about 95% homologous to the sequence RECLLPWLPLQISEGRS (SEQ ID NO:961) in M78076_PEA.sub.--1_P24 (SEQ ID NO:766).

According to preferred embodiments of the present invention, there is provided an isolated chimeric polypeptide encoding for M78076_PEA.sub.--1_P2 (SEQ ID NO:767), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQV corresponding to amino acids 1-449 of APP1_HUMAN (SEQ ID NO:760), which also corresponds to amino acids 1-449 of M78076_PEA.sub.--1_P2 (SEQ ID NO:767), and a second amino acid sequence being at least 70%, optionally at least 80%, preferably at least 85%, more preferably at least 90% and most preferably at least 95% homologous to a polypeptide having the sequence LTSFQLP-NAPLFLRRPRLRLFSCPLDPLS-VSWTPSYPLNTASLPLPSLSAQLPDPETWTLT CCVFD-PCFLALGFLLPPPSILCSVPWIFTAFPRIVFFFFFFLRQV LALSPRQESSVRSWLIAT STSWVQAILLPQPLE (SEQ ID NO:962) corresponding to amino acids 450-588 of M78076_PEA.sub.--1_P2 (SEQ ID NO:767), wherein said first amino acid sequence and second amino acid sequence are contiguous and in a sequential order.

According to preferred embodiments of the present invention, there is provided an isolated polypeptide encoding for a tail of M78076_PEA.sub.--1_P2 (SEQ ID NO:767), comprising a polypeptide being at least 70%, optionally at least about 80%, preferably at least about 85%, more preferably at least about 90% and most preferably at least about 95% homologous to the sequence TABLE-US-00072 LTSFQLPNA-PLFLRRPRLRLFSCPLDPLSVSWTPSY-PLNTASLPLPSLSAQLPDPETWTLT (SEQ ID NO:962) CCVFDPCFLALGFLLPPPSILCSVP-WIFTAFPRIVFFFFFFLRQVLALSPRQESSVRSWLIAT STSWVQAILLPQPLE in M78076_PEA__1_P2. (SEQ ID NO:767)

According to preferred embodiments of the present invention, there is provided an isolated chimeric polypeptide encoding for M78076_PEA.sub.--1_P25 (SEQ ID NO:768), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQ corresponding to amino acids 1-448 of APP1_HUMAN (SEQ ID NO:760), which also corresponds to amino acids 1-448 of M78076_PEA.sub.--1_P25 (SEQ ID NO:768), and a second amino acid sequence being at least 70%, optionally at least 80%, preferably at least 85%, more preferably at least 90% and most preferably at least 95% homologous to a polypeptide having the sequence PQNPN-SQPRAAGSLEVIISHPFVRRLEIL-ISPFQFQNSIPKNSQIVPAASPRGTSSP (SEQ ID NO:963) corresponding to amino acids 449-505 of M78076_PEA.sub.--1_P25 (SEQ ID NO:768), wherein said first amino acid sequence and second amino acid sequence are contiguous and in a sequential order.

According to preferred embodiments of the present invention, there is provided an isolated polypeptide encoding for a tail of M78076_PEA.sub.--1_P25 (SEQ ID NO:768), comprising a polypeptide being at least 70%, optionally at least about 80%, preferably at least about 85%, more preferably at least about 90% and most preferably at least about 95% homologous to the sequence PQNPNSQPRAAGSLEVIISH-PFVRRLEILISPFQFQNSIPKNSQIVPMSPRGTSSP (SEQ ID NO:963) in M78076_PEA.sub.--1_P25 (SEQ ID NO:768).

According to preferred embodiments of the present invention, there is provided an isolated chimeric polypeptide encoding for M85491_PEA.sub.--1_P13 (SEQ ID NO:246), comprising a first amino acid sequence being at least 90% homologous to MALRRLGMLLLLPLLAAVEETLMDST-TATAELGWMVHPPSGWEEVSGYDENMNTIR TYQVCNVFESSQNNWLRTKFIR-RRGAHRIHVEMKFSVRDCSSIPSVPGSCKETFNLYYY EADFDSATKTFPNWMENPWVKVDTIM-DESFSQVDLGGRVMKINTEVRSFGPVSRSGF YLAFQDYGGCMSLIAVRVFYRKCPRI-IQNGAIFQETLSGAESTSLVMRGSCIANAEEVD VPIK-LYCNGDGEWLVPIGRCMCKAGFEAV-ENGTVCRGCPSGTFKANQGDEACTHCPIN SRTTSEGATNCVCRNGYYRADLDPLD-MPCTTIPSAPQAVISSVNETSLMLEWTPPRDSG GREDLVYNIICKSCGSGRGACTRCGDN-VQYAPRQLGLTEPRIYISDLLAHTQYTFEIQAV NGVT-DQSPFSPQFASVNITTNQMPSAVSIM-HQVSRTVDSITLSWSQPDQPNGVILDYEL QYYEK corresponding to amino acids 1-476 of EPB2_HUMAN (SEQ ID NO:245), which also corresponds to amino acids 1-476 of M85491_PEA.sub.--1_P13 (SEQ ID NO:246), and a second amino acid sequence being at least 70%, optionally at least 80%, preferably at least 85%, more preferably at least 90% and most preferably at least 95% homologous to a polypeptide having the sequence VPIGWVLSPSPTSLRA-PLPG (SEQ ID NO:964) corresponding to amino acids 477-496 of M85491_PEA.sub.--1_P13 (SEQ ID NO:246), wherein said first and second amino acid sequences are contiguous and in a sequential order.

According to preferred embodiments of the present invention, there is provided an isolated polypeptide encoding for a tail of M85491_PEA.sub.--1_P13 (SEQ ID NO:246), comprising a polypeptide being at least 70%, optionally at least about 80%, preferably at least about 85%, more preferably at least about 90% and most preferably at least about 95% homologous to the sequence VPIGWVLSPSPTSLRAPLPG (SEQ ID NO:964) in M85491_PEA.sub.--1_P13 (SEQ ID NO:246).

According to preferred embodiments of the present invention, there is provided an isolated chimeric polypeptide encoding for M85491_PEA.sub.--1_P14 (SEQ ID NO:247), comprising a first amino acid sequence being at least 90% homologous to MALRRLGAALLLLPLLAAVEETLMD-STTATAELGWMVHPPSGWEEVSGYDENMNTIR TYQVCNVFESSQNNWLRTKFIR-RRGAHRIHVEMKFSVRDCSSIPSVPGSCKETFNLYYY EADFDSATKTFPNWMENPWVKVD-TIAADESFSQVDLGGRVMKINTEVRSFGPVSRSGF YLAFQDYGGCMSLIAVRVFYRKCPRI-IQNGAIFQETLSGAESTSLVMRGSCIANAEEVD VPIK-LYCNGDGEWLVPIGRCMCKAGFEAVENGTVCR corresponding to amino acids 1-270 of EPB2_HUMAN (SEQ ID NO:245), which also corresponds to amino acids 1-270 of M85491_PEA.sub.--1_P14 (SEQ ID NO:247), and a second amino acid sequence being at least 70%, optionally at least 80%, preferably at least 85%, more preferably at least 90% and most preferably at least 95% homologous to a polypeptide having the sequence ERQDLTMLSRLVLNSW-PQMILPPQPPKVLEL (SEQ ID NO:965) corresponding to amino acids 271-301 of M85491_PEA.sub.--1_P14 (SEQ ID NO:247), wherein said first and second amino acid sequences are contiguous and in a sequential order.

According to preferred embodiments of the present invention, there is provided an isolated polypeptide encoding for a tail of M85491_PEA.sub.--1_P14 (SEQ ID NO:247), comprising a polypeptide being at least 70%, optionally at least about 80%, preferably at least about 85%, more preferably at least about 90% and most preferably at least about 95% homologous to the sequence ERQDLTMLSRLVLNSW-PQMILPPQPPKVLEL (SEQ ID NO:965) in M85491_PEA.sub.--1_P14 (SEQ ID NO:247).

According to preferred embodiments of the present invention, there is provided an isolated chimeric polypeptide encoding for HSSTROL3_P4 (SEQ ID NO:271), comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:270), which also corresponds to amino acids 1-163 of HSSTROL3_P4 (SEQ ID NO:271), a bridging amino acid H corresponding to amino acid 164 of HSSTROL3_P4 (SEQ ID NO:271), a second amino acid sequence being at least 90% homologous to GDDLPFDGPGGILAHAFFPKTHREGDVH-FDYDETWTIGDDQGTDLLQVAAHEFGHVLG LQHTT-MKALMSAFYTFRYPLSLSPDDCRGVQH-LYGQPWPTVTSRTPALGPQAGIDTN EIAPLEPDAPPDACEASFDAVSTIRGEL-FFFKAGFVWRLRGGQLQPGYPALASRHWQGL PSPVDAAFEDAQGHIWFFQGAQY-WVYDGEKPVLGPAPLTELGLVRFPVHAALVWGPE KNKIYFFRGRDYWRFHPSTRRVD-SPVPRRATDWRGVPSEIDMFQDADG corresponding to amino acids 165-445 of MM11_HUMAN (SEQ ID NO:270), which also corresponds to amino acids 165-445 of HSSTROL3_P4 (SEQ ID NO:271), and a third amino acid sequence being at least 70%, optionally at least 80%, preferably at least 85%, more preferably at least 90% and most preferably at least 95% homologous to a polypeptide having the sequence ALGVRQLVGGGHSSRFSHLWAGL-PHACHRKSGSSSQVLCPEPSALLSVAG (SEQ ID NO:966) corresponding to amino acids 446-496 of HSSTROL3_P4 (SEQ ID NO:271), wherein said first amino acid sequence, bridging amino acid, second amino acid sequence and third amino acid sequence are contiguous and in a sequential order.

According to preferred embodiments of the present invention, there is provided an isolated polypeptide encoding for a tail of HSSTROL3_P4 (SEQ ID NO:271), comprising a polypeptide being at least 70%, optionally at least about 80%, preferably at least about 85%, more preferably at least about 90% and most preferably at least about 95% homologous to the sequence ALGVRQLVGGGHSSRFSHLWAGL-PHACHRKSGSSSQVLCPEPSALLSVAG (SEQ ID NO:966) in HSSTROL3_P4 (SEQ ID NO:271).

According to preferred embodiments of the present invention, there is provided an isolated chimeric polypeptide encoding for HSSTROL.sup.3_P5 (SEQ ID NO:272), comprising a first amino acid sequence being at least 90% homologous to MAPMWLRSAAARALLPPMLLLLLQPP-PLLARALPPDVHHLHAERRGPQPWHAALPSS PAPAP-ATQEAPRPASSLRPPRCGVPDPSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:270), which also corresponds to amino acids 1-163 of HSSTROL3_P5 (SEQ ID NO:272), a bridging amino acid H corresponding to amino acid 164 of HSSTROL3_P5 (SEQ ID NO:272), a second amino acid sequence being at least 90% homologous to GDDLPFDGPGGILAHAFFPKTHREGDVH-FDYDETWTIGDDQGTDLLQVAAHEFGHVLG LQHT-TAAKALMSAFYTFRYPLSLSPD-DCRGVQHLYGQPWPTVTSRTPALGPQAGIDTN EIAPLEPDAPPDACEASFDAVSTIRGEL-FFFKAGFVWRLRGGQLQPGYPALASRHWQGL PSPVDMFEDAQGHIWFFQ corresponding to amino acids 165-358 of MM11_HUMAN (SEQ ID NO:270), which also corresponds to amino acids 165-358 of HSSTROL3_P5 (SEQ ID NO:272), and a third amino acid sequence being at least 70%, optionally at least 80%, preferably at least 85%, more preferably at least 90% and most preferably at least 95% homologous to a polypeptide having the sequence ELGF-PSSTGRDESLEHCRCQGLHK (SEQ ID NO:967) corresponding to amino acids 359-382 of HSSTROL3_P5 (SEQ ID NO:272), wherein said first amino acid sequence, bridging amino acid, second amino acid sequence and third amino acid sequence are contiguous and in a sequential order.

According to preferred embodiments of the present invention, there is provided an isolated polypeptide encoding for a tail of HSSTROL3_P5 (SEQ ID NO:272), comprising a polypeptide being at least 70%, optionally at least about 80%, preferably at least about 85%, more preferably at least about 90% and most preferably at least about 95% homologous to the sequence ELGFPSSTGRDESLEHCRCQGLHK (SEQ ID NO:967) in HSSTROL3_P5 (SEQ ID NO:272).

According to preferred embodiments of the present invention, there is provided an isolated chimeric polypeptide encoding for HSSTROL3_P7 (SEQ ID NO:273), comprising a first amino acid sequence being at least 90% homologous to MAPAAWLRSAAARALLPPMLLLLLQPP-PLLARALPPDVHHLHAERRGPQPWHMLPSS PAPAP-ATQEAPRPASSLRPPRCGVPDSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:270), which also corresponds to amino acids 1-163 of HSSTROL3_P7 (SEQ ID NO:273), a bridging amino acid H corresponding to amino acid 164 of HSSTROL3_P7 (SEQ ID NO:273), a second amino acid sequence being at least 90% homologous to GDDLPFDGPGGILAHAFFPKTHREGDVH-FDYDETWTIGDDQGTDLLQVMHEFGHVLG LQHTT-MKALMSAFYTFRYPLSLSPDDCRGVQH-LYGQPWPTVTSRTPALGPQAGIDTN EIAPLEPDAPPDACEASFDAVSTIRGEL-FFFKAGFVWRLRGGQLQPGYPALASRHWQGL PSPVDAAFEDAQGHIWFFQG corresponding to amino acids 165-359 of MM11_HUMAN (SEQ ID NO:270), which also corresponds to amino acids 165-359 of HSSTROL3_P7 (SEQ ID NO:273), and a third amino acid sequence being at least 70%, optionally at least 80%, preferably at least 85%, more preferably at least 90% and most preferably at least 95% homologous to a polypeptide having the sequence TTGVST-PAPGV (SEQ ID NO:968) corresponding to amino acids 360-370 of HSSTROL3_P7 (SEQ ID NO:273), wherein said first amino acid sequence, bridging amino acid, second amino acid sequence and third amino acid sequence are contiguous and in a sequential order.

According to preferred embodiments of the present invention, there is provided an isolated polypeptide encoding for a tail of HSSTROL3_P7 (SEQ ID NO:273), comprising a polypeptide being at least 70%, optionally at least about 80%, preferably at least 85%, more preferably at least about 90% and most preferably at least about 95% homologous to the sequence TTGVSTPAPGV (SEQ ID NO:968) in HSSTROL3_P7 (SEQ ID NO:273).

According to preferred embodiments of the present invention, there is provided an isolated chimeric polypeptide encoding for HSSTROL3_P8 (SEQ ID NO:274), comprising a first amino acid sequence being at least 90% homologous to MAPMWLRSAAARALLPPMLLLLLQPP-PLLARALPPDVHHLHAERRGPQPWHAALPSS PAPAP-ATQEAPRPASSLRPPRCGVPDPSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:270), which also corresponds to amino acids 1-163 of HSSTROL3_P8 (SEQ ID NO:274), a bridging amino acid H corresponding to amino acid 164of HSSTROL3_P8 (SEQ ID NO:274), a second amino acid sequence being at least 90% homologous to GDDLPFDGPGGILAHAFFPKTHREGDVH-FDYDETWTIGDDQGTDLLQVAAHEFGHVLG LQHTT-MKALMSAFYTFRYPLSLSPDDCRGVQH-LYGQPWPTVTSRTPALGPQAGIDTNEIAPLE corresponding to amino acids 165-286 of MM11_HUMAN (SEQ ID NO:270), which also corresponds to amino acids 165-286 of HSSTROL3_P8 (SEQ ID NO:274), and a third amino acid sequence being at least 70%, optionally at least 80%, preferably at least 85%, more preferably at least 90% and most preferably at least 95% homologous to a polypeptide having the sequence VRPCLPVPLLLCWPL (SEQ ID NO:969) corresponding to amino acids 287-301 of HSSTROL3_P8 (SEQ ID NO:274), wherein said first amino acid sequence, bridging amino acid, second amino acid sequence and third amino acid sequence are contiguous and in a sequential order.

According to preferred embodiments of the present invention, there is provided an isolated polypeptide encoding for a tail of HSSTROL3_P8 (SEQ ID NO:274), comprising a polypeptide being at least 70%, optionally at least about 80%, preferably at least 85%, more preferably at least about 90% and most preferably at least about 95% homologous to the sequence VRPCLPVPLLLCWPL (SEQ ID NO:969) in HSSTROL3_P8 (SEQ ID NO:274).

According to preferred embodiments of the present invention, there is provided an isolated chimeric polypeptide encoding for HSSTROL3_P9 (SEQ ID NO:275), comprising a first amino acid sequence being at least 90% homologous to MAPMWLRSAAARALLPPMLLLLLQPP-PLLARALPPDVHHLHAERRGPQPWHMLPSS PAPAP-ATQEAPRPASSLRPPRCGVPDPSDGLSARNRQK corresponding to amino acids 1-96 of MM11_HUMAN (SEQ ID NO:270), which also corresponds to amino acids 1-96 of HSSTROL3_P9 (SEQ ID NO:275), a second amino acid sequence being at least 90% homologous to RILRFP-WQLVQEQVRQTMAEALKVWSDVTPLT-FTEVHEGRADIMIDFARYW corresponding to amino acids 113-163 of MM11_HUMAN (SEQ ID NO:270), which also corresponds to amino acids 97-147 of HSSTROL3_P9 (SEQ ID NO:275), a bridging amino acid H corresponding to amino acid 148 of HSSTROL3_P9 (SEQ ID NO:275), a third amino acid sequence being at least 90% homologous to GDDLPFDGPGGILAHAFFPKTHREGDVH-FDYDETWTIGDDQGTDLLQVAAHEFGHVLG LQHT-TAAKALMSAFYTFRYPLSLSPD-DCRGVQHLYGQPWPTVTSRTPALGPQAGIDTN EIAPLEPDAPPDACEASFDAVSTIRGEL-FFFKAGFVWRLRGGQLQPGYPALASRHWQGL PSPVDMFEDAQGHIWFFQG corresponding to amino acids 165-359 of MM11_HUMAN (SEQ ID NO:270), which also corresponds to amino acids 149-343 of HSSTROL3_P9 (SEQ ID NO:275), and a fourth amino acid sequence being at least 70%, optionally at least 80%, preferably at least 85%, more preferably at least 90% and most preferably at least 95% homologous to a polypeptide having the sequence TTGVST-PAPGV (SEQ ID NO:968) corresponding to amino acids 344-354 of HSSTROL3_P9 (SEQ ID NO:275), wherein said first amino acid sequence, second amino acid sequence, bridging amino acid, third amino acid sequence and fourth amino acid sequence are contiguous and in a sequential order.

According to preferred embodiments of the present invention, there is provided an isolated chimeric polypeptide encoding for an edge portion of HSSTROL3_P9 (SEQ ID NO:275), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KR, having a structure as follows: a sequence starting from any of amino acid numbers 96-x to 96; and ending at any of amino acid numbers 97+((n−2)-x), in which x varies from 0 to n−2.

According to preferred embodiments of the present invention, there is provided an isolated polypeptide encoding for a tail of HSSTROL3_P9 (SEQ ID NO:275), comprising a polypeptide being at least 70%, optionally at least about 80%, preferably at least about 85%, more preferably at least about 90% and most preferably at least about 95% homologous to the sequence TTGVSTPAPGV (SEQ ID NO:968) in HSSTROL3_P9 (SEQ ID NO:275).

According to preferred embodiments of the present invention, there is provided an isolated chimeric polypeptide encoding for AY180924_PEA.sub.--1_P3 (SEQ ID NO:281), comprising a first amino acid sequence being at least 90% homologous to MLNVSGLFVLLCGLLVSSSAQEV-LAGVSSQLLN corresponding to amino acids 1-33 of LATH_HUMAN (SEQ ID NO:280), which also corresponds to amino acids 1-33 of AY180924_PEA.sub.--1_P3 (SEQ ID NO:281), and a second amino acid sequence being at least 70%, optionally at least 80%, preferably at least 85%, more preferably at least 90% and most preferably at least 95% homologous to a polypeptide having the sequence GETVLL-WVMQNPEPMPVKFSLAKYLGHNEHY (SEQ ID NO:971) corresponding to amino acids 34-64 of AY180924_PEA.sub.--1_P3 (SEQ ID NO:281), wherein said first and second amino acid sequences are contiguous and in a sequential order.

According to preferred embodiments of the present invention, there is provided an isolated polypeptide encoding for a tail of AY180924_PEA.sub.--1_P3 (SEQ ID NO:281), comprising a polypeptide being at least 70%, optionally at least about 80%, preferably at least about 85%, more preferably at least about 90% and most preferably at least about 95% homologous to the sequence GETVLLWVMQNPEP-MPVKFSLAKYLGHNEHY (SEQ ID NO:971) in AY180924_PEA.sub.--1_P3 (SEQ ID NO:281).

According to preferred embodiments of the present invention, there is provided an isolated chimeric polypeptide encoding for R75793_PEA.sub.--1_P2 (SEQ ID NO:295), comprising a first amino acid sequence being at least 90% homologous to MKFLAVLVLLGVSIFLVSAQNPTTAA-PADTYPATGPADDEAPDAETTAAATTATTMPT TATT-MSTTARKDIP corresponding to amino acids 1-74 of Q96DR8 (SEQ ID NO:294), which also corresponds to amino acids 1-74 of R75793_PEA.sub.--1_P2 (SEQ ID NO:295), and a second amino acid sequence being at least 70%, optionally at least 80%, preferably at least 85%, more preferably at least 90% and most preferably at least 95% homologous to a polypeptide having the sequence AP corresponding to amino acids 75-76 of R75793_PEA.sub.--1_P2 (SEQ ID NO:295), wherein said first amino acid sequence and second amino acid sequence are contiguous and in a sequential order.

According to preferred embodiments of the present invention, there is provided an isolated chimeric polypeptide encoding for HUMCA1XIA_P14 (SEQ ID NO:350), comprising a first amino acid sequence being at least 90% homologous to MEPWSSRWKTKRWLWDFTVTTLALT-FLFQAREVRGAAPVDVLKALDFHNSPEGISKTT GFCTNRKNSKGSDTAYRVSKQAQLSAPT-KQLFPGGTFPEDFSILFTVKPKKGIQSFLLSIY NEH-GIQQIGVEVGRSPVFLFEDHTGKPA-PEDYPLFRTVNIADGKWHRVAISVEKKTVTM IVDCKKKTTKPLDRSERAIVDTNGITVF-GTRILDEEVFEGDIQQFLITGDPKAAYDYCEH YSPD-CDSSAPKAAQAQEPQIDEYAPEDIIEY-DYEYGEAEYKEAESVTEGPTVTEETIAQT EANIVDDFQEYNYGTMESYQTEAPRHVS-GTNEPNPVEEIFTEEYLTGEDYDSQRKNSED TLYEN-KEIDGRDSDLLVDGDLGEYD-FYEYKEYEDKPTSPPNEEFGPGVPAETDITETSIN GHGAYGEKGQKGEPAWEPGMLVEGPPG-PAGPAGIMGPPGLQGPTGPPGDPGDRGPPG RPGLP-GADGLPGPPGTMLMLPFRYGGDGSKGP-TISAQEAQAQAILQQARIALRGPPGPM GLTGRPGPVGGPGSSGAKGESGDPGPQG-PRGVQGPPGPTGKPGKRGRPGADGGRGMP GEP-GAKGDRGFDGLPGLPGDKGHRGERGPQG-PPGPPGDDGMRGEDGEIGPRGLPGEAG PRGLLGPRGTPGAPGQPGMAGVDGPPGP-KGNMGPQGEPGPPGQQGNPGPQGLPGPQG PIGP-PGEKGPQGKPGLAGLPGADGPPGH-PGKEGQSGEKGALGPPGPQGPIGYPGPRGVK GADGVRGLKGSKGEKGEDGFPGFKGD-MGLKGDRGEVGQIGPRGEDGPEGPKGRAGPT GDPGPSGQAGEKGKLGVPGLPGYPGRQG-PKGSTGFPGFPGANGEKGARGVAGKPGPR GQRGPT-GPRGSRGARGPTGKPGPKGTSGGDGPPG-PPGERGPQGPQGPVGFPGPKGPPGP PGKDGLPGHPGQRGETGFQGKTGPPGPG-GWGPQGPTGETGPIGERGHPGPPGPPGEQG LPG-MGKEGAKGDPGPQGISGKDGPAGLRGF-PGERGLPGAQGAPGLKGGEGPQGPPGPV corresponding to amino acids 1-1056 of CA1B_HUMAN_V5 (SEQ ID NO:349), which also corresponds to amino acids 1-1056 of HUMCA1XIA_P14 (SEQ ID NO:350), and a second amino acid sequence being at least 70%, optionally at least 80%, preferably at least 85%, more preferably at least 90% and most preferably at least 95% homologous to a polypeptide having the sequence VSMMI-INSQTIMWNYSSSFITLML (SEQ ID NO:972) corresponding to amino acids 1057-1081 of HUMCA1XIA_P14 (SEQ ID NO:350), wherein said first amino acid sequence and second amino acid sequence are contiguous and in a sequential order.

According to preferred embodiments of the present invention, there is provided an isolated polypeptide encoding for a tail of HUMCA1XIA_P14 (SEQ ID NO:350), comprising a polypeptide being at least 70%, optionally at least about 80%, preferably at least about 85%, more preferably at least about 90% and most preferably at least about 95% homologous to the sequence VSMMIINSQTIMWNYSSSFITLML (SEQ ID NO:972) in HUMCA1XIA_P14 (SEQ ID NO:350).

According to preferred embodiments of the present invention, there is provided an isolated chimeric polypeptide encoding for HUMCA1XIA_P15 (SEQ ID NO:351 ), comprising a first amino acid sequence being at least 90% homologous to MEPWSSRWKTKRWLWDFTVTTLALT-FLFQAREVRGAAPVDVLKALDFHNSPEGISKTT GFCTNRKNSKGSDTAYRVSKQAQLSAPT-KQLFPGGTFPEDFSILFTVKPKKGIQSFLLSIY NEH-GIQQIGVEVGRSPVFLFEDHTGKPA-PEDYPLFRTVNIADGKWHRVAISVEKKTVTM IVDCKKKTTKPLDRSERAIVDTNGITVF-GTRILDEEVFEGDIQQFLITGDPKAAYDYCEH YSPD-CDSSAPKAAQAQEPQIDEYAPEDIIEY-DYEYGEAEYKEAESVTEGPTVTEETIAQT EANIVDDFQEYNYGTMESYQTEAPRHVS-GTNEPNPVEEIFTEEYLTGEDYDSQRKNSED TLYEN-KEIDGRDSDLLVDGDLGEYD-FYEYKEYEDKPTSPPNEEFGPGVPAETDITETSIN GHGAYGEKGQKGEPAWEPGMLVEGPPG-PAGPAGIMGPPGLQGPTGPPGDPGDRGPPG RPGLP-GADGLPGPPGTMLMLPFRYGGDGSKGP-TISAQEAQAQAILQQARIALRGPPGPM GLTGRPGPVGGPGSSGAKGESGDPGPQG-PRGVQGPPGPTGKPGKRGRPGADGGRGMP GEP-GAKGDRGFDGLPGLPGDKGHRGERGPQG-PPGPPGDDGMRGEDGEIGPRGLPGEAG PRGLLGPRGTPGAPGQPGMAGVDGPPGP-KGNMGPQGEPGPPGQQGNPGPQGLPGPQG PIGP-PGEK corresponding to amino acids 1-714 of CA1B_HUMAN (SEQ ID NO:348), which also corresponds to amino acids 1-714 of HUMCA1XIA_P15 (SEQ ID NO:351), and a second amino acid sequence being at least 70%, optionally at least 80%, preferably at least 85%, more preferably at least 90% and most preferably at least 95% homologous to a polypeptide having the sequence MCCNLS-FGILIPLQK (SEQ ID NO:973) corresponding to amino acids 715-729 of HUMCA1XIA_P15 (SEQ ID NO:351), wherein said first amino acid sequence and second amino acid sequence are contiguous and in a sequential order.

According to preferred embodiments of the present invention, there is provided an isolated polypeptide encoding for a tail of HUMCA1XIA_P15 (SEQ ID NO :351 ), comprising a polypeptide being at least 70%, optionally at least about 80%, preferably at least about 85%, more preferably at least about 90% and most preferably at least about 95% homologous to the sequence MCCNLSFGILIPLQK (SEQ ID NO:973) in HUMCA1XIA_P15 (SEQ ID NO:351).

According to preferred embodiments of the present invention, there is provided an isolated chimeric polypeptide encoding for HUMCA1XIA_P16 (SEQ ID NO:352), comprising a first amino acid sequence being at least 90% homologous to MEPWSSRWKTKRWLWDFTVTTLALT-FLFQAREVRGAAPVDVLKALDFHNSPEGISKTT GFCTNRKNSKGSDTAYRVSKQAQLSAPT-KQLFPGGTFPEDFSILFTVKPKKGIQSFLLSIY NEH-GIQQIGVEVGRSPVFLFEDHTGKPA-PEDYPLFRTVNIADGKWHRVAISVEKKTVTM IVDCKKKTTKPLDRSERAIVDTNGITVF-GTRILDEEVFEGDIQQFLITGDPKAAYDYCEH YSPD-CDSSAPKAAQAQEPQIDEYAPEDIIEY-DYEYGEAEYKEAESVTEGPTVTEETIAQT EANIVDDFQEYNYGTMESYQTEAPRHVS-GTNEPNPVEEIFTEEYLTGEDYDSQRKNSED TLYEN-KEIDGRDSDLLVDGDLGEYD-FYEYKEYEDKPTSPPNEEFGPGVPAETDITETSIN GHGAYGEKGQKGEPAWEPGMLVEGPPG-PAGPAGIMGPPGLQGPTGPPGDPGDRGPPG RPGLP-GADGLPGPPGTMLMLPFRYGGDGSKGP-TISAQEAQAQAILQQARIALRGPPGPM GLTGRPGPVGGPGSSGAKGESGDPGPQG-PRGVQGPPGPTGKPGKRGRPGADGGRGMP GEP-GAKGDRGFDGLPGLPGDKGHRGERGPQG-PPGPPGDDGMRGEDGEIGPRGLPGEA corresponding to amino acids 1-648 of CA1B_HUMAN (SEQ ID NO:348), which also corresponds to amino acids 1-648 of HUMCA1XIA_P16 (SEQ ID NO:352), a second amino acid sequence being at least 90% homologous to GMAGVDGP-PGPKGNMGPQGEPGPPGQQGNPG-PQGLPGPQGPIGPPGEK corresponding to amino acids 667-714 of CA1B_HUMAN (SEQ ID NO:348), which also corresponds to amino acids 649-696 of HUMCA1XIA_P16 (SEQ ID NO:352), and a third amino acid sequence being at least 70%, optionally at least 80%, preferably at least 85%, more preferably at least 90% and most preferably at least 95% homologous to a polypeptide having the sequence VSFSFS-LFYKKVIKFACDKRFVGRHDERKWKLSLPLYLIYE (SEQ ID NO:974) corresponding to amino acids 697-738 of HUMCA1XIA_P16 (SEQ ID NO:352), wherein said first amino acid sequence, second amino acid sequence and third amino acid sequence are contiguous and in a sequential order.

According to preferred embodiments of the present invention, there is provided an isolated chimeric polypeptide encoding for an edge portion of HUMCA1XIA_P16 (SEQ ID NO:352), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AG, having a structure as follows: a sequence starting from any of amino acid numbers 648-x to 648; and ending at any of amino acid numbers 649+((n−2)-x), in which x varies from 0 to n−2.

According to preferred embodiments of the present invention, there is provided an isolated polypeptide encoding for a tail of HUMCA1XIA_P16 (SEQ ID NO:352), comprising a polypeptide being at least 70%, optionally at least about 80%, preferably at least about 85%, more preferably at least about 90% and most preferably at least about 95% homologous to the sequence VSFSFSLFYKKVIKFACD-KRFVGRHDERKVVKLSLPLYLIYE (SEQ ID NO:974) in HUMCA1XIA_P16 (SEQ ID NO:352).

According to preferred embodiments of the present invention, there is provided an isolated chimeric polypeptide encoding for HUMCA1XIA_P17 (SEQ ID NO:353), comprising a first amino acid sequence being at least 90% homologous to MEPWSSRWKTKRWLWDFTVTTLALT-FLFQAREVRGAAPVDVLKALDFHNSPEGISKTT GFCTNRKNSKGSDTAYRVSKQAQLSAPT-KQLFPGGTFPEDFSILFTVKPKKGIQSFLLSIY NEH-GIQQIGVEVGRSPVFLFEDHTGKPA-PEDYPLFRTVNIADGKWHRVAISVEKKTVTM IVDCKKKTTKPLDRSERAIVDTNGITVF-GTRILDEEVFEGDIQQFLITGDPKAAYDYCEH YSPD-CDSSAPKAAQAQEPQIDE corresponding to amino acids 1-260 of CA_B_HUMAN (SEQ ID NO:348), which also corresponds to amino acids 1-260 of HUMCA1XIA_P17 (SEQ ID NO:353), and a second amino acid sequence being at least 70%, optionally at least 80%, preferably at least 85%, more preferably at least 90% and most preferably at least 95% homologous to a polypeptide having the sequence VRSTR-PEKVFVFQ (SEQ ID NO:975) corresponding to amino acids 261-273 of HUMCA1XIA_P17 (SEQ ID NO:353), wherein said first amino acid sequence and second amino acid sequence are contiguous and in a sequential order.

According to preferred embodiments of the present invention, there is provided an isolated polypeptide encoding for a tail of HUMCA1XIA_P17 (SEQ ID NO:353), comprising a polypeptide being at least 70%, optionally at least about 80%, preferably at least about 85%, more preferably at least about 90% and most preferably at least about 95% homologous to the sequence VRSTRPEKVFVFQ (SEQ ID NO:975) in HUMCA1XIA_P17 (SEQ ID NO:353).

According to preferred embodiments of the present invention, there is provided an isolated chimeric polypeptide encoding for R20779_P2 (SEQ ID NO:380), comprising a first amino acid sequence being at least 90% homologous to MCAERLGQFMTLALVLATFDPARGTDAT-NPPEGPQDRSSQQKGRLSLQNTAEIQHCLV NAGD-VGCGVFECFENNSCEIRGLHGICMTFLH-NAGKFDAQGKSFIKDALKCKAHALRH RFGCISRKCPAIREMVSQLQRECYLKH-DLCAAAQENTRVIVEMIHFKDLLLHE corresponding to amino acids 1-169 of STC2_HUMAN (SEQ ID NO:379), which also corresponds to amino acids 1-169 of R20779_P2 (SEQ ID NO:380), and a second amino acid sequence being at least 70%, optionally at least 80%, preferably at least 85%, more preferably at least 90% and most preferably at least 95% homologous to a polypeptide having the sequence CYKIE-ITMPKRRKVKLRD (SEQ ID NO:976) corresponding to amino acids 170-187 of R20779_P2 (SEQ ID NO:380), wherein said first amino acid sequence and second amino acid sequence are contiguous and in a sequential order.

According to preferred embodiments of the present invention, there is provided an isolated polypeptide encoding for a tail of R20779_P2 (SEQ ID NO:380), comprising a polypeptide being at least 70%, optionally at least about 80%, preferably at least about 85%, more preferably at least about 90% and most preferably at least about 95% homologous to the sequence CYKIEITMPKRRKVKLRD (SEQ ID NO:976) in R20779_P2 (SEQ ID NO:380).

According to preferred embodiments of the present invention, there is provided an isolated chimeric polypeptide encoding for HSCOC4_PEA.sub.--1_P3 (SEQ ID NO:488), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTV corresponding to amino acids 1-865 of CO4_HUMAN, which also corresponds to amino acids 1-865 of HSCOC4_PEA.sub.--1_P3 (SEQ ID NO:488), and a second amino acid sequence being at least 70%, optionally at least 80%, preferably at least 85%, more preferably at least 90% and most preferably at least 95% homologous to a polypeptide having the sequence RPHRSLSIQELGEPGP-SEGWGG (SEQ ID NO:977) corresponding to amino acids 866-887 of HSCOC4_PEA.sub.--1_P3 (SEQ ID NO:488), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P3 (SEQ ID NO:488), comprising a polypeptide being at least 70%, optionally at least about 80%, preferably at least about 85%, more preferably at least about 90% and most preferably at least about 95% homologous to the sequence RPHRSLSIQELGEPGPSEG-WGG (SEQ ID NO:977) in HSCOC4_PEA.sub.--1_P3 (SEQ ID NO:488).

According to preferred embodiments of the present invention, there is provided an solated chimeric polypeptide encoding for HSCOC4_PEA.sub.--1_P5 (SEQ ID NO:489), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKG corresponding to amino acids 1-818 of CO4_HUMAN, which also corresponds to amino acids 1-818 of HSCOC4_PEA.sub.--1_P5 (SEQ ID NO:489), and a second amino acid sequence being at least 70%, optionally at least 80%, preferably at least 85%, more preferably at least 90% and most preferably at least 95% homologous to a polypeptide having the sequence DVTLS-GPQVTLLPFPCTPAPCSLCS (SEQ ID NO:978) corresponding to amino acids 819-843 of HSCOC4_PEA.sub.--1_P5 (SEQ ID NO:489), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P5 (SEQ ID NO:489), comprising a polypeptide being at least 70%, optionally at least about 80%, preferably at least about 85%, more preferably at least about 90% and most preferably at least about 95% homologous to the sequence DVTLSGPQVTLLPFPCTPA-PCSLCS (SEQ ID NO:978) in HSCOC4_PEA.sub.--1_P5 (SEQ ID NO:489).

According to preferred embodiments of the present invention, there is provided an isolated chimeric polypeptide encoding for HSCOC4_PEA.sub.--1_P6 (SEQ ID NO:490), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV- LYNYLDKNLTVSVHVSPVEGLCLAGGGGLAQ QVLVPAGSARPVAFSVVPTAAAAVSLKV- VARGSFEFPVGDAVSKVLQIEKEGAIHREEL VYELN- PLDHRGRTLEIPGNSDPNMIPDGDFN- SYVRVTASDPLDTLGSEGALSPGGVASL LRLPRGCGEQTMIYLAPTLMSRYLDKTE- QWSTLPPETKDHAVDLIQKG corresponding to amino acids 1-1052 of CO4_HUMAN, which also corresponds to amino acids 1-1052 of HSCOC4_PEA.sub.--1_P6 (SEQ ID NO:490), and a second amino acid sequence being at least 70%, optionally at least 80%, preferably at least 85%, more preferably at least 90% and most preferably at least 95% homologous to a polypeptide having the sequence SGCK- GKQEGGQERTVTGRWTAQEATEGKKGGP (SEQ ID NO:979) corresponding to amino acids 1053-1084 of HSCOC4_PEA.sub.--1_P6 (SEQ ID NO:490), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P6 (SEQ ID NO:490), comprising a polypeptide being at least 70%, optionally at least about 80%, preferably at least about 85%, more preferably at least about 90% and most preferably at least about 95% homologous to the sequence SGCKGKQEGGQERTVTGR- WTAQEATEGKKGGP (SEQ ID NO:979) in HSCOC4_PEA.sub.--1_P6 (SEQ ID NO:490).

According to preferred embodiments of the present invention, there is provided an isolated chimeric polypeptide encoding for HSCOC4_PEA.sub.--1_P12 (SEQ ID NO:491), comprising a first amino acid sequence being at least 90% homologous to MRLLWGLIWASSFFTLSLQKPRLLLF- SPSVVHLGVPLSVGVQLQDVPRGQVVKGSVFLR NPSRNNVPCSPKVDFTLSSERD- FALLSLQVPLKDAKSCGLHQLLRGPE- VQLVAHSPWLK DSLSRTTNIQGINLLFSSR- RGHLFLQTDQPIYNPGQRVRYRVFALDQKMRPSTDT ITVMV ENSHGLRVRKKEVYMPSSIFQDDFVIP- DISEPGTWKISARFSDGLESNSSTQFEVKKYVL PNFE- VKITPGKPYILTVPGHLDEMQLDIQARY- IYGKPVQGVAYVRFGLLDEDGKKTFFR GLESQTKLVNGQSHISLSKAEFQDALEK- LNMGITDLQGLRLYVAAAIIESPGGEMEEAE LTSWY- FVSSPFSLDLSKTKRHLVPGAP- FLLQALVREMSGSPASGIPVKVSATVSSPGSVP EVQDIQQNTDGSGQVSIPIIIPQ- TISELQLSVSAGSPHPAIAR- LTVAAPPSGGPGFLSIERPD SRPPRVGDTLNLNL- RAVGSGATFSHYYYMILSRGQIVFMNREPKRTLTSV SVFVDHHLA PSFYFVAFYYHGDHPVANSLRVDVQA- GACEGKLELSVDGAKQYRNGESVKLHLETDS LAL- VALGALDTALYAAGSKSHKPLN- MGKVFEAMNSYDLGCGPGGGDSALQVFQAAG LAFSDGDQWTLSRKRLSCPKEKT- TRKKRNVNFQKAINEKLGQYASPTAKRCCQDGVTR LPMMRSCEQRAARVQQPDCREPFLSCCQ- FAESLRKKSRDKGQAGLQRALEILQEEDLID EDDIPVRSFFPENWLWRVETVDRF- QILTLWLPDSLTTWEIHGLSLSKTKGLCVATPVQL RVFREFHLHLRLPMSVRRFEQLELRPV- LYNYLDKNLTVSVHVSPVEGLCLAGGGGLAQ QVLVPAGSARPVAFSVVPTAAAAVSLKV- VARGSFEFPVGDAVSKVLQIEKEGAIHREEL VYELN- PLDHRGRTLEIPGNSDPNMIPDGDFN- SYVRVTASDPLDTLGSEGALSPGGVASL LRLPRGCGEQTMIYLAPTLMSRYLDKTE- QWSTLPPETKDHAVDLIQKGYMRIQQFRK ADGSYM- WLSRDSSTWLTAFVLKVLSLAQEQVGGS- PEKLQETSNWLLSQQQADGSFQ DPCPVLDRSMQGGLVGNDETVALTAFV- TIALHHGLAVFQDEGAEPLKQRVEASISKASS FLGEKASAGLLGAHAAAITAYALTLTKA- PADLRGVAHNNLMAMAQETGDNLYWGSV TGSQS- NAVSPTPAPRNPSDPMPQAPALWIET- TAYALLHLLLHEGKAEMADQAAAWLTR QGSFQGGFRSTQDTVIALDALSAY- WIASHTTEERGLNVTLSSTGRNGFKSHALQLNNRQ IRGLEEELQFSLGSKINVKVGGNSKGTLKV corresponding to amino acids 1-1380 of CO4_HUMAN_V1(SEQ ID NO:486), which also corresponds to amino acids 1-1380 of HSCOC4_PEA.sub.--1_P12 (SEQ ID NO:491), and a second amino acid sequence being at least 70%, optionally at least 80%, preferably at least 85%, more preferably at least 90% and most preferably at least 95% homologous to a polypeptide having the sequence RAREGVG- PGTGGGEGVE (SEQ ID NO:980) corresponding to amino acids 1381-1397 of HSCOC4_PEA.sub.--1_P12 (SEQ ID NO:491), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P12 (SEQ ID NO:491), comprising a polypeptide being at least 70%, optionally at least about 80%, preferably at least about 85%, more preferably at least about 90% and most preferably at least about 95% homologous to the sequence RAREGVGPGTGGGEGVE (SEQ ID NO:980) in HSCOC4_PEA.sub.--1_P12 (SEQ ID NO:491).

According to preferred embodiments of the present invention, there is provided an isolated chimeric polypeptide encoding for HSCOC4_PEA.sub.--1_P15 (SEQ ID NO:492), comprising a first amino acid sequence being at least 90% homologous to MRLLWGLIWASSFFTLSLQKPRLLLF- SPSVVHLGVPLSVGVQLQDVPRGQVVKGSVFLR NPSRNNVPCSPKVDFTLSSERD- FALLSLQVPLKDAKSCGLHQLLRGPE- VQLVAHSPWLK DSLSRTTNIQGINLLFSSR- RGHLFLQTDQPIYNPGQRVRYRVFALDQKMRPSTD TITVMV ENSHGLRVRKKEVYMPSSIFQDDFVIP- DISEPGTWKISARFSDGLESNSSTQFEVKKYVL PNFE- VKITPGKPYILTVPGHLDEMQLDIQARY- IYGKPVQGVAYVRFGLLDEDGKKTFFR GLESQTKLVNGQSHISLSKAEFQDALEK- LNMGITDLQGLRLYVAAAIIESPGGEMEEAE LTSWY- FVSSPFSLDLSKTKRHLVPGAP- FLLQALVREMSGSPASGIPVKVSATVSSPGSVP EVQDIQQNTDGSGQVSIPIIIPQ- TISELQLSVSAGSPHPAIAR- LTVAAPPSGGPGFLSIERPD SRPPRVGDTLNLNL- RAVGSGATFSHYYYMILSRGQIVFMNREPKRTLTSVS VFVDHHLA PSFYFVAFYYHGDHPVANSLRVDVQA- GACEGKLELSVDGAKQYRNGESVKLHLETDS LAL- VALGALDTALYAASKSHKPLN- MGKVFEAMNSYDLGCGPGGGDSALQVFQAAG LAFSDGDQWTLSRKRLSCPKEKT- TRKKRNVNFQKAINEKLGQYASPTAKRCCQDGVTR LPMMRSCEQRAARVQQPDCREPFLSCCQ- FAESLRKKSRDKGQAGLQRALEILQEEDLID EDDIPVRSFFPENWLWRVETVDRF- QILTLWLPDSLTTWEIHGLSLSKTKGLCVATPVQL RVFREFHLHLRLPMSVRRFEQLELRPV- LYNYLDKNLTVSVHVSPVEGLCLAGGGGLAQ QVLVPAGSARPVAFSVVPTAAAAVSLKV- VARGSFEFPVGDAVSKVLQIEKEGAIHREEL VYELN- PLDHRGRTLEIPGNSDPNMIPDGDFN-SYVRVTASDPLDTLGSEGALSPGGVASL LRLPRGCGEQTMIYLAPTLMSRYLDKTE-QWSTLPPETKDHAVDLIQKGYMRIQQFRK ADGSYMWLSRDSSTWLTAFVLKVLSLAQEQVGGS-PEKLQETSNWLLSQQQADGSFQ DPCPVLDRSMQGGLVGNDETVALTAFV-TIALHHGLAVFQDEGAEPLKQRVEASISKASS FLGEKASAGLLGAHAMITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQ corresponding to amino acids 1-1359 of CO4_HUMAN_V1 (SEQ ID NO:486), which also corresponds to amino acids 1-1359 of HSCOC4_PEA.sub.--1_P15 (SEQ ID NO:492), and a second amino acid sequence being at least 70%, optionally at least 80%, preferably at least 85%, more preferably at least 90% and most preferably at least 95% homologous to a polypeptide having the sequence VNHSLVNHSLAWVARTPGPRGQARSRPQPP-TRGIPAALLPGVFGGRLTSWLRDLEL (SEQ ID NO:981) corresponding to amino acids 1360-1415 of HSCOC4_PEA.sub.--1_P15 (SEQ ID NO:492), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P15 (SEQ ID NO:492), comprising a polypeptide being at least 70%, optionally at least about 80%, preferably at least about 85%, more preferably at least about 90% and most preferably at least about 95% homologous to the sequence VNHSLVNHSLAWVARTPG-PRGQARSRPQPPTRGIPAALLPGVFGGR-LTSWLRDLEL (SEQ ID NO:981) in HSCOC4_PEA.sub.--1_P15 (SEQ ID NO:492).

According to preferred embodiments of the present invention, there is provided an isolated chimeric polypeptide encoding for HSCOC4_PEA.sub.--1_P16 (SEQ ID NO:493), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYMWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPK corresponding to amino acids 1-1457 of CO4_HUMAN_V1 (SEQ ID NO:486), which also corresponds to amino acids 1-1457 of HSCOC4_PEA.sub.--1_P16 (SEQ ID NO:493), and a second amino acid sequence being at least 70%, optionally at least 80%, preferably at least 85%, more preferably at least 90% and most preferably at least 95% homologous to a polypeptide having the sequence AERQGGAVWHGHR-GRHPPEWIPRPAC (SEQ ID NO:982) corresponding to amino acids 1458-1483 of HSCOC4_PEA.sub.--1_P16 (SEQ ID NO:493), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P16 (SEQ ID NO:493), comprising a polypeptide being at least 70%, optionally at least about 80%, preferably at least about 85%, more preferably at least about 90% and most preferably at least about 95% homologous to the sequence AERQGGAVWHGHR-GRHPPEWIPRPAC (SEQ ID NO:982) in HSCOC4_PEA.sub.--1_P16 (SEQ ID NO:493).

According to preferred embodiments of the present invention, there is provided an isolated chimeric polypeptide encoding for HSCOC4_PEA.sub.--1_P20 (SEQ ID NO:494), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYMWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQ corresponding to amino acids 1-1303 of CO4_HUMAN_V1 (SEQ ID NO:486), which also corresponds to amino acids 1-1303 of HSCOC4_PEA.sub.--1_P20 (SEQ ID NO:494), and a second amino acid sequence being at least 70%, optionally at least 80%, preferably at least 85%, more preferably at least 90% and most preferably at least 95% homologous to a polypeptide having the sequence VGAVPGLWRGWVVLRPRA-CLSPGSTSLGHGDCPGCPVCLLDCLPHH (SEQ ID NO:983) corresponding to amino acids 1304-1349 of HSCOC4_PEA.sub.--1_P20 (SEQ ID NO:494), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P20 (SEQ ID NO:494), comprising a polypeptide being at least 70%, optionally at least about 80%, preferably at least about 85%, more preferably at least about 90% and most preferably at least about 95% homologous to the sequence TABLE-US-00073 (SEQ ID NO: 983) VGAVPGLWRGWVVLRPRA-CLSPGSTSLGHGDCPGCPVCLLDCLPHH (SEQ ID NO: 494) in HSCOC4_PEA__1_P20.

According to preferred embodiments of the present invention, there is provided an isolated chimeric polypeptide encoding for HSCOC4_PEA.sub.--1_P9 (SEQ ID NO:495), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLMSRYLDKTE-QWSTLPPETKDHAVDLIQKGYMRIQQFRK ADGSYM-WLSRDSSTWLTAFVLKVLSLAQEQVGGS-PEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKWEEQESRV HYTVCIWRNGKVGLSGMAIADVTLLSGF-HALRADLEKLTSLSDRYVSHFETEGPHVLLYFDSV corresponding to amino acids 1-1529 of CO4_HUMAN_V1 (SEQ ID NO:486), which also corresponds to amino acids 1-1529 of HSCOC4_PEA.sub.--1_P9 (SEQ ID NO:495), and a second amino acid sequence being at least 70%, optionally at least 80%, preferably at least 85%, more preferably at least 90% and most preferably at least 95% homologous to a polypeptide having the sequence SGER (SEQ ID NO:984) corresponding to amino acids 1530-1533 of HSCOC4_PEA.sub.--1_P9 (SEQ ID NO:495), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P9 (SEQ ID NO:495), comprising a polypeptide being at least 70%, optionally at least about 80%, preferably at least about 85%, more preferably at least about 90% and most preferably at least about 95% homologous to the sequence SGER (SEQ ID NO:984) in HSCOC4_PEA.sub.--1_P9 (SEQ ID NO:495).

According to preferred embodiments of the present invention, there is provided an isolated chimeric polypeptide encoding for HSCOC4_PEA.sub.--1_P22 (SEQ ID NO:496), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIPDISEPGTWKISARFSDGLESNSSTQFEVKKYVL PNFEVKITPGKPYILTVPGHLDEMQLDIQARYIYGKPVQGVAYVRFGLLDEDGKKTFFR GLESQTKLVNGQSHISLSKAEFQDALEKLNMGITDLQGLRLYVAAAIIESPGGEMEEAE LTSWYFVSSPFSLDLSKTKRHLVPGAPFLLQALVREMSGSPASGIPVKVSATVSSPGSVP EVQDIQQNTDGSGQVSIPIIIPQTISELQLSVSAGSPHPAIARLTVAAPPSGGPGFLSIERPD SRPPRVGDTLNLNLRAVGSGATFSHYYYMILSRGQIVFMNREPKRTLTSVS VFVDHHLA PSFYFVAFYYHGDHPVANSLRVDVQAGACEGKLELSVDGAKQYRNGESVKLHLETDS LALVALGALDTALYAAGSKSHKPLNMGKVFEAMNSYDLGCGPGGGDSALQVFQAAG LAFSDGDQWTLSRKRLSCPKEKTTRKKRNVNFQKAINEKLGQYASPTAKRCCQDGVTR LPMMRSCEQRAARVQQPDCREPFLSCCQFAESLRKKSRDKGQAGLQRALEILQEEDLID EDDIPVRSFFPENWLWRVETVDRFQILTLWLPDSLTTWEIHGLSLSKTKGLCVATPVQL RVFREFHLHLRLPMSVRRFEQLELRPVLYNYLDKNLTVSVHVSPVEGLCLAGGGGLAQ QVLVPAGSARPVAFSVVPTAAAAVSLKVVARGSFEFPVGDAVSKVLQIEKEGAIHREEL VYELNPLDHRGRTLEIPGNSDPNMIPDGDFNSYVRVTASDPLDTLGSEGALSPGGVASL LRLPRGCGEQTMIYLAPTLAASRYLDKTEQWSTLPPETKDHAVDLIQKGYMRIQQFRK ADGSYAAWLSRDSSTWLTAFVLKVLSLAQEQVGGSPEKLQETSNWLLSQQQADGSFQ DPCPVLDRSMQGGLVGNDETVALTAFVTIALHHGLAVFQDEGAEPLKQRVEASISKASS FLGEKASAGLLGAHAMITAYALTLTKAPADLRGVAHNNLMAMAQETGDNLYWGSV TGSQSNAVSPTPAPRNPSDPMPQAPALWIETTAYALLHLLLHEGKAEMADQAAAWLTR QGSFQGGFRSTQDTVIALDALSAYWIASHTTEERGLNVTLSSTGRNGFKSHALQLNNRQ IRGLEEELQFSLGSKINVKVGGNSKGTLKVLRTYNVLDMKNTTCQDLQIEVTVKGHVE YTMEANEDYEDYELPAKDDPDAPLQPVTPLQLFEGRRNRRRREAPKWEEQESRV HYTVCIWRNGKVGLSGMAIADVTLLSGFHALRADLEKLTSLSDRYVSHFETEGPHVLL YFDSVPTSRECVGFEAVQEVPVGLVQPASATLYDYYNPERRCSVFYGAPSKSRLLATLC SAEVCQCAEGKCPRQRRALERGLQDEDGYRMKFACYYPRVEYGFQVKVLREDSRAAF RLFETKITQVLHF corresponding to amino acids 1-1653 of CO4_HUMAN_V1 (SEQ ID NO:486), which also corresponds to amino acids 1-1653 of HSCOC4_PEA.sub.--1_P22 (SEQ ID NO:496), and a second amino acid sequence being at least 70%, optionally at least 80%, preferably at least 85%, more preferably at least 90% and most preferably at least 95% homologous to a polypeptide having the sequence SMKQTGEAGRAGGRQGG (SEQ ID NO:985) corresponding to amino acids 1654-1670 of HSCOC4_PEA.sub.--1_P22 (SEQ ID NO:496), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P22 (SEQ ID NO:496), comprising a polypeptide being at least 70%, optionally at least about 80%, preferably at least about 85%, more preferably at least about 90% and most preferably at least about 95% homologous to the sequence SMKQTGEAGRAGGRQGG (SEQ ID NO:985) in HSCOC4_PEA.sub.--1_P22 (SEQ ID NO:496).

According to preferred embodiments of the present invention, there is provided an isolated chimeric polypeptide encoding for HSCOC4_PEA.sub.--1_P23 (SEQ ID NO:497), comprising a first amino acid sequence being at least 90% homologous to MRLLWGLIWASSFFTLSLQKPRLLLFSPSVVHLGVPLSVGVQLQDVPRGVVWKGSVFLR NPSRNNVPCSPKVDFTLSSERDFALLSLQVPLKDAKSCGLHQLLRGPEVQLVAHSPWLK DSLSRTTNIQGINLLFSSRRGHLFLQTDQPIYNPGQRVRYRVFALDQKMRPSTDT ITVMV ENSHGLRVRKKEVYMPSSIFQDDFVIPDISEPGTWKISARFSDGLESNSSTQFEVKKYVL PNFEVKITPGKPYILTVPGHLDEMQLDIQARYIYGKPVQGVAYVRFGLLDEDGKKTFFR GLESQTKLVNGQSHISLSKAEFQDALEKLNMGITDLQGLRLYVAAAIIESPGGEMEEAE LTSWYFVSSPFSLDLSKTKRHLVPGAPFLLQALVREMSGSPASGIPVKVSATVSSPGSVP EVQDIQQNTDGSGQVSIPIIIPQTISELQLSVSAGSPHPAIARLTVAAPPSGGPGFLSIERPD SRPPRVGDTLNLNLRAVGSGATFSHYYYMILSRGQIVFMNREPKRTLTSVS VFVDHHLA PSFYFVAFYYHGDHPVANSLRVDVQAGACEGKLELSVDGAKQYRNGESVKLHLETDS LALVALGALDTALYMGSKSHKPLNMGKVFEAMNSYDLGCGPGGGDSALQVFQAAG LAFSDGDQWTLSRKRLSCPKEKTTRKKRNVNFQKAINEKLGQYASPTAKRCCQDGVTR LPMMRSCEQRAARVQQPDCREPFLSCCQFAESLRKKSRDKGQAGLQRALEILQEEDLID EDDIPVRSFFPENWLWRVETVDRFQILTLWLPDSLTTWEIHGLSLSKTKGLCVATPVQL RVFREFHLHLRLPMSVRRFEQLELRPVLYNYLDKNLTVSVHVSPVEGLCLAGGGGLAQ QVLVPAGSARPVAFSVVPTAAAAVSLKVVARGSFEFPVGDAVSKVLQIEKEGAIHREEL VYELNPLDHRGRTLEIPGNSDPNMIPDGDFNSYVRVTASDPLDTLGSEGALSPGGVASL LRLPRGCGEQTMIYLAPTLMSRYLDKTEQWSTLPPETKDHAVDLIQKGYMRIQQFRK ADGSYAAWLSRDSSTWLTAFVLKVLSLAQEQVGGSPEKLQETSNWLLSQQQADGSFQ DPCPVLDRSMQGGLVGNDETVALTAFVTIALHHGLAVFQDEGAEPLKQRVEASISKASS FLGEKASAGLLGAHAAAITAYALTLTKAPADLRGVAHNNLMAMAQETGDNLYWGSV TGSQSNAVSPTPAPRNPSDPMPQAPALWIETTAYALLHLLLHEGKAEMADQAAAWLTR QGSFQGGFRSTQDTVIALDALSAYWIASHTTEERGLNVTLSSTGRNGFKSHALQLNNRQ IRGLEEELQFSLGSKINVKVGGNSKGTLKVLRTYNVLDMKNTTCQDLQIEVTVKGHVE YTMEANEDYEDYELPAKDDPDAPLQPVTPLQLFEGRRNRRRREAPKWEEQESRV HYTVCIWRNGKVGLSGMAIADVTLLSGFHALRADLEKLTSLSDRYVSHFETEGPHVLL YFDSVPTSRECVGFEAVQEVPVGLVQPASATLYDYYNPERRCSVFYGAPSKSRLLATLC SAEVCQCAEGKCPRQRRALERGLQDEDGYRMKFACYYPRVEYG corresponding to amino acids 1-1626 of CO4_HUMAN_V1 (SEQ ID NO:486), which also corresponds to amino acids 1-1626 of HSCOC4_PEA.sub.--1_P23 (SEQ ID NO:497), and a second amino acid sequence being at least 70%, optionally at least 80%, preferably at least 85%, more preferably at least 90% and most preferably at least 95% homologous to a polypeptide having the sequence QSSHRGPGLTLPRGPAVLVSLGVACSSYRSCTQPVCSDTNFLPSQPQSNSPFPLLLTPS (SEQ ID NO:986) corresponding to amino acids 1627-1685 of HSCOC4_PEA.sub.--1_P23 (SEQ ID NO:497), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P23 (SEQ ID NO:497), comprising a polypeptide being at least 70%, optionally at least about 80%, preferably at least about 85%, more preferably at least about 90% and most preferably at least about 95% homologous to the sequence QSSHRGPGLTLPRGPAVLVSLGVACSSYRSCTQPVCSDTN-FLPSQPQSNSPFPLLLTPS (SEQ ID NO:986) in HSCOC4_PEA.sub.--1_P23 (SEQ ID NO:497).

According to preferred embodiments of the present invention, there is provided an isolated chimeric polypeptide encoding for HSCOC4_PEA.sub.--1_P24 (SEQ ID NO:498), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLMSRYLDKTE-QWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKWEEQESRV HYTVCIWRNGKVGLSGMAIADVTLLSGF-HALRADLEKLTSLSDRYVSHFETEGPHVLLYFDS corresponding to amino acids 1-1528 of CO4_HUMAN_V1 (SEQ ID NO:486), which also corresponds to amino acids 1-1528 of HSCOC4_PEA.sub.--1_P24 (SEQ ID NO:498), and a second amino acid sequence being at least 70%, optionally at least 80%, preferably at least 85%, more preferably at least 90% and most preferably at least 95% homologous to a polypeptide having the sequence SADVLCFTGHQVRAD-SWPPCVLLKSASVLRGSALASVAPWSGVCRTRMATG (SEQ ID NO:987) corresponding to amino acids 1529-1579 of HSCOC4_PEA.sub.--1_P24 (SEQ ID NO:498), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P24 (SEQ ID NO:498), comprising a polypeptide being at least 70%, optionally at least about 80%, preferably at least about 85%, more preferably at least about 90% and most preferably at least about 95% homologous to the sequence TABLE-US-00074 SADVL-CFTGHQVRADSWPPCVLLKSASVLRG-SALASVAPWSGVCRTRMATG (SEQ ID NO: 987) in HSCOC4_PEA__1_P24. (SEQ ID NO: 498)

According to preferred embodiments of the present invention, there is provided an isolated chimeric polypeptide encoding for HSCOC4_PEA.sub.--1_P25 (SEQ ID NO:499), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN- SYVRVTASDPLDTLGSEGALSPGGVASLLRLPRGCGEQTMIYLAPTLMSRYLDKTEQWSTLPPETKDHAVDLIQKGYMRIQQFRK ADGSYMWLSRDSSTWLTAFVLKVLSLAQEQVGGSPEKLQETSNWLLSQQQADGSFQ DPCPVLDRSMQGGLVGNDETVALTAFVTIALHHGLAVFQDEGAEPLKQRVEASISKASS FLGEKASAGLLGAHAAAITAYALTLTKAPADLRGVAHNNLMAMAQETGDNLYWGSV TGSQSNAVSPTPAPRNPSDPMPQAPALWIETTAYALLHLLLHEGKAEMADQAAAWLTR QGSFQGGFRSTQDTVIALDALSAYWIASHTTEERGLNVTLSSTGRNGFKSHALQLNNRQ IRGLEEELQFSLGSKINVKVGGNSKGTLKVLRTYNVLDMKNTTCQDLQIEVTVKGHVE YTMEANEDYEDYEYDELPAKDDPDAPLQPVTPLQLFEGRRNRRRREAPKWEEQESRV HYTVCIWRNGKVGLSGMAIADVTLLSGFHALRADLEKLTSLSDRYVSHFETEGPHVLL YFDSVPTSRECVGFEAVQEVPVGLVQPASATLYDYYNPERRCSVFYGAPSKSRLLATLC SAEVCQCAEG corresponding to amino acids 1-1593 of CO4_HUMAN_V1 (SEQ ID NO:486), which also corresponds to amino acids 1-1593 of HSCOC4_PEA.sub.--1_P25 (SEQ ID NO:499), and a second amino acid sequence being at least 70%, optionally at least 80%, preferably at least 85%, more preferably at least 90% and most preferably at least 95% homologous to a polypeptide having the sequence ETEGLGRGSGGGMAGAPPTLSDGFPNFREVPSPASRPGAGSAGRGWLQDEVCLLLPPC GVRLPG (SEQ ID NO:988) corresponding to amino acids 1594-1657 of HSCOC4_PEA.sub.--1_P25 (SEQ ID NO:499), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P25 (SEQ ID NO:499), comprising a polypeptide being at least 70%, optionally at least about 80%, preferably at least about 85%, more preferably at least about 90% and most preferably at least about 95% homologous to the sequence TABLE-US-00075 ETEGLGRGSGGGMAGAPPTLSDGFPNFREVPSPASRPGAGSAGRGWLQDEVCLLLPPC (SEQ ID NO: 988) GVRLPG in HSCOC4_PEA__1_P25. (SEQ ID NO: 499)

According to preferred embodiments of the present invention, there is provided an isolated chimeric polypeptide encoding for HSCOC4_PEA.sub.--1_P26 (SEQ ID NO:500), comprising a first amino acid sequence being at least 90% homologous to MRLLWGLIWASSFFTLSLQKPRLLLFSPSVVHLGVPLSVGVQLQDVPRGQVVKGSVFLR NPSRNNVPCSPKVDFTLSSERDFALLSLQVPLKDAKSCGLHQLLRGPEVQLVAHSPWLK DSLSRTTNIQGINLLFSSRRGHLFLQTDQPIYNPGQRVRYRVFALDQKMRPSTDT ITVMV ENSHGLRVRKKEVYMPSSIFQDDFVIPDISEPGTWKISARFSDGLESNSSTQFEVKKYVL PNFEVKITPGKPYILTVPGHLDEMQLDIQARYIYGKPVQGVAYVRFGLLDEDGKKTFFR GLESQTKLVNGQSHISLSKAEFQDALEKLNMGITDLQGLRLYVAAAIIESPGGEMEEAE LTSWYFVSSPFSLDLSKTKRHLVPGAPFLLQALVREMSGSPASGIPVKVSATVSSPGSVP EVQDIQQNTDGSGQVSIPIIIPQTISELQLSVSAGSPHPAIARLTVAAPPSGGPGFLSIERPD SRPPRVGDTLNLNLRAVGSGATFSHYYYMILSRGQIVFMNREPKRTLTSVS VFVDHHLA PSFYFVAFYYHGDHPVANSLRVDVQAGACEGKLELSVDGAKQYRNGESVKLHLETDS LALVALGALDTALYAAGSKSHKPLNMGKVFEAMNSYDLGCGPGGGDSALQVFQAAG LAFSDGDQWTLSRKRLSCPKEKTTRKKRNVNFQKAINEKLGQYASPTAKRCCQDGVTR LPMMRSCEQRAARVQQPDCREPFLSCCQFAESLRKKSRDKGQAGLQRALEILQEEDLID EDDIPVRSFFPENWLWRVETVDRFQILTLWLPDSLTTWEIHGLSLSKTKGLCVATPVQL RVFREFHLHLRLPMSVRRFEQLELRPVLYNYLDKNLTVSVHVSPVEGLCLAGGGGLAQ QVLVPAGSARPVAFSVVPTAAAAVSLKVVARGSFEFPVGDAVSKVLQIEKEGAIHREEL VYELNPLDHRGRTLEIPGNSDPNMIPDGDFNSYVRVTASDPLDTLGSEGALSPGGVASL LRLPRGCGEQTMIYLAPTLAASRYLDKTEQWSTLPPETKDHAVDLIQKGYMRIQQFRK ADGSYMWLSRDSSTWLTAFVLKVLSLAQEQVGGSPEKLQETSNWLLSQQQADGSFQ DPCPVLDRSMQGGLVGNDETVALTAFVTIALHHGLAVFQDEGAEPLKQRVEASISKASS FLGEKASAGLLGAHAAAITAYALTLTKAPADLRGVAHNNLMAMAQETGDNLYWGSV TGSQSNAVSPTPAPRNPSDPMPQAPALWIETTAYALLHLLLHEGKAEMADQAAAWLTR QGSFQGGFRSTQDTVIALDALSAYWIASHTTEERGLNVTLSSTGRNGFKSHALQLNNRQ IRGLEEELQFSLGSKINVKVGGNSKGTLKVLRTYNVLDMKNTTCQDLQIEVTVKGHVE YTMEANEDYEDYEYDELPAKDDPDAPLQPVTPLQLFEGRRNRRRREAPKWEEQESRV HYTVCIWRNGKVGLSGMAIADVTLLSGFHALRADLEKLTSLSDRYVSHFETEGPHVLL YFDSVPTSRECVGFEAVQEVPVGLVQPASATLYDYYNPERRCSVFYGAPSKSRLLATLC SAEVCQCAEG corresponding to amino acids 1-1593 of CO4_HUMAN_V1 (SEQ ID NO:486), which also corresponds to amino acids 1-1593 of HSCOC4_PEA.sub.--1_P26 (SEQ ID NO:500), and a second amino acid sequence being at least 70%, optionally at least 80%, preferably at least 85%, more preferably at least 90% and most preferably at least 95% homologous to a polypeptide having the sequence TABLE-US-00076 ETEGLGRGSGGGMAGAPPTLSDGFPNFREVPSPASRPGAGSAGRGWLQDEVCLLLPPC (SEQ ID NO: 989) GVRSVFPPRPWPDPPSGTGCFGLSGCSLLLLQVMHMCLL corresponding to amino acids 1594-1691 of HSCOC4_PEA.sub.--1_P26 (SEQ ID NO:500), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P26 (SEQ ID NO:500), comprising a polypeptide being at least 70%, optionally at least about 80%, preferably at least about 85%, more preferably at least about 90% and most preferably at least about 95% homologous to the sequence TABLE-US-00077 ETEGLGRGSGGGMAGAPPTLSDGFPNFREVPSPASRPGAGSAGRGWLQDEVCLLLPPC (SEQ ID NO: 989) GVRSVFPPRPWPDPPSGTGCFGLSGCSLLLLQVMHMCLL in HSCOC4_PEA__1_P26. (SEQ ID NO: 500)

According to preferred embodiments of the present invention, there is provided an isolated chimeric polypeptide encoding for HSCOC4_PEA.sub.--1_P30 (SEQ ID NO:501), comprising a first amino acid sequence being at least 90% homologous to MRLLWGLIWASSFFTLSLQKPRLLLF- SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYMWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGS corresponding to amino acids 1-1232 of CO4_HUMAN_V3 (SEQ ID NO:487), which also corresponds to amino acids 1-1232 of HSCOC4_PEA.sub.--1_P30 (SEQ ID NO:501), and a second amino acid sequence being at least 70%, optionally at least 80%, preferably at least 85%, more preferably at least 90% and most preferably at least 95% homologous to a polypeptide having the sequence RNPVRLLQPRAQMFCVLRGTK (SEQ ID NO:990) corresponding to amino acids 1233-1253 of HSCOC4_PEA.sub.--1_P30 (SEQ ID NO:501), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P30 (SEQ ID NO:501), comprising a polypeptide being at least 70%, optionally at least about 80%, preferably at least about 85%, more preferably at least about 90% and most preferably at least about 95% homologous to the sequence RNPVRLLQPRAQMFCVL-RGTK (SEQ ID NO:990) in HSCOC4_PEA.sub.--1_P30 (SEQ ID NO:501).

According to preferred embodiments of the present invention, there is provided an isolated chimeric polypeptide encoding for HSCOC4_PEA.sub.--1_P38 (SEQ ID NO:502), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKG corresponding to amino acids 1-818 of CO4_HUMAN, which also corresponds to amino acids 1-818 of HSCOC4_PEA.sub.--1_P38 (SEQ ID NO:502), and a second amino acid sequence being at least 70%, optionally at least 80%, preferably at least 85%, more preferably at least 90% and most preferably at least 95% homologous to a polypeptide having the sequence DVTLS-GPQVTLLPFPCTPAPCSLCS (SEQ ID NO:978) corresponding to amino acids 819-843 of HSCOC4_PEA.sub.--1_P38 (SEQ ID NO:502), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P38 (SEQ ID NO:502), comprising a polypeptide being at least 70%, optionally at least about 80%, preferably at least about 85%, more preferably at least about 90% and most preferably at least about 95% homologous to the sequence DVTLSGPQVTLLPFPCTPA-PCSLCS (SEQ ID NO:978) in HSCOC4_PEA.sub.--1_P38 (SEQ ID NO:502).

According to preferred embodiments of the present invention, there is provided an isolated chimeric polypeptide encoding for HSCOC4_PEA.sub.--1_P39 (SEQ ID NO:503), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAPFLLQ corresponding to amino acids 1-387 of CO4_HUMAN, which also corresponds to amino acids 1-387 of HSCOC4_PEA.sub.--1_P39 (SEQ ID NO:503), and a second amino acid sequence being at least 70%, optionally at least 80%, preferably at least 85%, more preferably at least 90% and most preferably at least 95% homologous to a polypeptide having the sequence VSS-RGEG (SEQ ID NO:992) corresponding to amino acids 388-394 of HSCOC4_PEA.sub.--1_P39 (SEQ ID NO:503), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P39 (SEQ ID NO:503), comprising a polypeptide being at least 70%, optionally at least about 80%, preferably at least about 85%, more preferably at least about 90% and most preferably at least about 95% homologous to the sequence VSSRGEG (SEQ ID NO:992) in HSCOC4_PEA.sub.--1_P39 (SEQ ID NO:503).

According to preferred embodiments of the present invention, there is provided an isolated chimeric polypeptide encoding for HSCOC4_PEA.sub.--1_P40 (SEQ ID NO:504), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKY corresponding to amino acids 1-236 of CO4_HUMAN, which also corresponds to amino acids 1-236 of HSCOC4_PEA.sub.--1_P40 (SEQ ID NO:504), and a second amino acid sequence being at least 70%, optionally at least 80%, preferably at least 85%, more preferably at least 90% and most preferably at least 95% homologous to a polypeptide having the sequence AGEWTEPHFPLKGRVPGRPGEAEYGHY (SEQ ID NO:993) corresponding to amino acids 237-263 of HSCOC4_PEA.sub.--1_P40 (SEQ ID NO:504), wherein said first amino acid sequence and second amino acid sequence are contiguous and in a sequential order.

According to preferred embodiments of the present invention, there is provided an isolated polypeptide encoding for a tail of HSCOC4_PEA.sub.--1_P40 (SEQ ID NO:504), comprising a polypeptide being at least 70%, optionally at least about 80%, preferably at least about 85%, more preferably at least about 90% and most preferably at least about 95% homologous to the sequence AGEWTEPHFPLKGRVPGR-PGEAEYGHY (SEQ ID NO:993) in HSCOC4_PEA.sub.--1_P40 (SEQ ID NO:504).

According to preferred embodiments of the present invention, there is provided an isolated chimeric polypeptide encoding for HSCOC4_PEA.sub.--1_P41 (SEQ ID NO:505), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLMSRYLDKTE-QWSTLPPETKDHAVDLIQKGYMRIQQFRK ADGSYM-WLSRDSSTWLTAFVLKVLSLAQEQVGGS-PEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKWEEQESRV HYTVCIWRNGKVGLSGMAIADVTLLSGF-HALRADLEKLTSLSDRYVSHFETEGPHVLLYFDSV corresponding to amino acids 1-1529 of CO4_HUMAN_V1 (SEQ ID NO:486), which also corresponds to amino acids 1-1529 of HSCOC4_PEA.sub.--1_P41 (SEQ ID NO:505), and a second amino acid sequence being at least 70%, optionally at least 80%, preferably at least 85%, more preferably at least 90% and most preferably at least 95% homologous to a polypeptide having the sequence SGER (SEQ ID NO:984) corresponding to amino acids 1530-1533 of HSCOC4_PEA.sub.--1_P41 (SEQ ID NO:505), wherein said first amino acid sequence and second amino acid sequence are contiguous and in a sequential order.

According to preferred embodiments of the present invention, there is provided an isolated polypeptide encoding for a tail of HSCOC4_PEA.sub.--1.sub.--I P41 (SEQ ID NO:505), comprising a polypeptide being at least 70%, optionally at least about 80%, preferably at least about 85%, more preferably at least about 90% and most preferably at least about 95% homologous to the sequence SGER (SEQ ID NO:984) in HSCOC4_PEA.sub.--1_P41 (SEQ ID NO:505).

According to preferred embodiments of the present invention, there is provided an isolated chimeric polypeptide encoding for HSCOC4_PEA.sub.--1_P42 (SEQ ID NO:506), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY- IYGKPVQGVAYVRFGLLDEDGKKTFFR
GLESQTKLVNGQSHISLSKAEFQDALEK-
LNMGITDLQGLRLYVAAAIIESPGGEMEEAE LTSWY-
FVSSPFSLDLSKTKRHLVPGAP-
FLLQALVREMSGSPASGIPVKVSATVSSPGSVP
EVQDIQQNTDGSGQVSIPIIIPQ-
TISELQLSVSAGSPHPAIAR-
LTVAAPPSGGPGFLSIERPD SRPPRVGDTLNLNL-
RAVGSGATFSHYYYMILSRGQIVFMNREPKRTLTSVS
VFVDHHLA PSFYFVAFYYHGDHPVANSLRVDVQA-
GACEGKLELSVDGAKQYRNGESVKLHLETDS LAL-
VALGALDTALYMGSKSHKPLN-
MGKVFEAMNSYDLGCGPGGGDSALQVFQAAG
LAFSDGDQWTLSRKRLSCPKEKT-
TRKKRNVNFQKAINEKLGQYASPTAKRCCQDGVTR
LPMMRSCEQRAARVQQPDCREPFLSCCQ-
FAESLRKKSRDKGQAGLQRALEILQEEDLID
EDDIPVRSFFPENWLWRVETVDRF-
QILTLWLPDSLTTWEIHGLSLSKTKGLCVATPVQL
RVFREFHLHLRLPMSVRRFEQLELRPV-
LYNYLDKNLTVSVHVSPVEGLCLAGGGGLAQ
QVLVPAGSARPVAFSVVPTAAAAVSLKV-
VARGSFEFPVGDAVSKVLQIEKEGAIHREEL VYELN-
PLDHRGRTLEIPGNSDPNMIPDGDFN-
SYVRVTASDPLDTLGSEGALSPGGVASL
LRLPRGCGEQTMIYLAPTLAASRYLDK-
TEQWSTLPPETKDHAVDLIQKGYMRIQQFRK
ADGSYMWLSRDSSTWLTAFVLKV-
LSLAQEQVGGSPEKLQETSNWLLSQQQADGSFQ
DPCPVLDRSMQGGLVGNDETVALTAFV-
TIALHHGLAVFQDEGAEPLKQRVEASISKASS
FLGEKASAGLLGAHAAAITAYALTLTKA-
PADLRGVAHNNLMAMAQETGDNLYWGSV TGSQS-
NAVSPTPAPRNPSDPMPQAPALWIET-
TAYALLHLLLHEGKAEMADQAAAWLTR
QGSFQGGFRSTQDTVIALDALSAY-
WIASHTTEERGLNVTLSSTGRNGFKSHALQLNNRQ
IRGLEEELQFSLGSKINVKVGGN-
SKGTLKVLRTYNVLDMKNTTCQDLQIEVTVKGHVE
YTMEANEDYEDYEYDELPAKDDPDA-
PLQPVTPLQLFEGRRNRRRREAPKWEEQESRV
HYTVCIW corresponding to amino acids 1-1473 of CO4_HUMAN_V1 (SEQ ID NO:486), which also corresponds to amino acids 1-1473 of HSCOC4_PEA.sub.--1_P42 (SEQ ID NO:506), a second amino acid sequence being at least 70%, optionally at least-80%, preferably at least 85%, more preferably at least 90% and most preferably at least 95% homologous to a polypeptide having the sequence WAPGMLGQGREGRTQAGAGLLEPAQAEPGRQLTRLHR (SEQ ID NO:1021) corresponding to amino acids 1474-1511 of HSCOC4_PEA.sub.--1_P42 (SEQ ID NO:506), a third amino acid sequence being at least 90% homologous to RNGKVGLSGMAIADVTLLSGFHALRADLEK corresponding to amino acids 1474-1503 of CO4_HUMAN_V1 (SEQ ID NO:486), which also corresponds to amino acids 1512-1541 of HSCOC4_PEA.sub.--1_P42 (SEQ ID NO:506), and a fourth amino acid sequence being at least 70%, optionally at least 80%, preferably at least 85%, more preferably at least 90% and most preferably at least 95% homologous to a polypeptide having the sequence VWSATQGNPLCPRY (SEQ ID NO:995) corresponding to amino acids 1542-1555 of HSCOC4_PEA.sub.--1_P42 (SEQ ID NO:506), wherein said first amino acid sequence, second amino acid sequence, third amino acid sequence and fourth amino acid sequence are contiguous and in a sequential order.

According to preferred embodiments of the present invention, there is provided an isolated polypeptide encoding for an edge portion of HSCOC4_PEA.sub.--1_P42 (SEQ ID NO:506), comprising an amino acid sequence being at least 70%, optionally at least about 80%, preferably at least about 85%, more preferably at least about 90% and most preferably at least about 95% homologous to the sequence encoding for WAPGMLGQGREGRTQA-
GAGLLEPAQAEPGRQLTRLHR (SEQ ID NO: 1021), corresponding to HSCOC4_PEA.sub.--1_P42 (SEQ ID NO:506).

According to preferred embodiments of the present invention, there is provided an isolated polypeptide encoding for a tail of HSCOC4 PEA.sub.--1_P42 (SEQ ID NO:506), comprising a polypeptide being at least 70%, optionally at least about 80%, preferably at least about 85%, more preferably at least about 90% and most preferably at least about 95% homologous to the sequence VWSATQGNPLCPRY (SEQ ID NO:995) in HSCOC4_PEA.sub.--1_P42 (SEQ ID NO:506).

According to preferred embodiments of the present invention, there is provided an isolated chimeric polypeptide encoding for HUMTREFAC_PEA.sub.--2_P8 (SEQ ID NO:518), comprising a first amino acid sequence being at least 90% homologous to MMRALCMLGLVLALLSSS-SAEEYVGL corresponding to amino acids 1-27 of TFF3_HUMAN (SEQ ID NO:516), which also corresponds to amino acids 1-27 of HUMTREFAC_PEA.sub.--2_P8 (SEQ ID NO:518), and a second amino acid sequence being at least 70%, optionally at least 80%, preferably at least 85%, more preferably at least 90% and most preferably at least 95% homologous to a polypeptide having the sequence WKVHLPKGEGFSSG (SEQ ID NO:996) corresponding to amino acids 28-41 of HUMTREFAC_PEA.sub.--2_P8 (SEQ ID NO:518), wherein said first amino acid sequence and second amino acid sequence are contiguous and in a sequential order.

According to preferred embodiments of the present invention, there is provided an isolated polypeptide encoding for a tail of HUMTREFAC_PEA.sub.--2_P8 (SEQ ID NO:518), comprising a polypeptide being at least 70%, optionally at least about 80%, preferably at least about 85%, more preferably at least about 90% and most preferably at least about 95% homologous to the sequence WKVHLPKGEGFSSG (SEQ ID NO:996) in HUMTREFAC_PEA.sub.--2_P8 (SEQ ID NO:518).

According to preferred embodiments of the present invention, there is provided an isolated chimeric polypeptide encoding for HUMOSTRO_PEA.sub.--1_PEA.sub.--1_P21 (SEQ ID NO:553), comprising a first amino acid sequence being at least 90% homologous to MRIAVICF-CLLGITCAIPVKQADSGSSEEKQ-
LYNKYPDAVATWLNPDPSQKQNLLAPQ corresponding to amino acids 1-58 of OSTP_HUMAN (SEQ ID NO:552), which also corresponds to amino acids 1-58 of HUMOSTRO_ PEA.sub.--1_PEA.sub.--1_P21 (SEQ ID NO:553), and a second amino acid sequence being at least 70%, optionally at least 80%, preferably at least 85%, more preferably at least 90% and most preferably at least 95% homologous to a polypeptide having the sequence VFLNFS (SEQ ID NO:997) corresponding to amino acids 59-64 of HUMOSTRO_PEA.sub.--1_PEA.sub.--1_$_P$21 (SEQ ID NO:553), wherein said first amino acid sequence and second amino acid sequence are contiguous and in a sequential order.

According to preferred embodiments of the present invention, there is provided an isolated polypeptide encoding for a tail of HUMOSTRO_PEA.sub.--1_PEA.sub.--1_P21 (SEQ ID NO:553), comprising a polypeptide being at least 70%, optionally at least about 80%, preferably at least about 85%, more preferably at least about 90% and most preferably at least about 95% homologous to the sequence VFLNFS (SEQ ID NO:997) in HUMOSTRO_PEA.sub.--1_PEA.sub.--1_P21 (SEQ ID NO:553).

According to preferred embodiments of the present invention, there is provided an isolated chimeric polypeptide encoding for HUMOSTRO_PEA.sub.--1_PEA.sub.--1_P25 (SEQ ID NO:554), comprising a first amino acid sequence being at least 90% homologous to MRIAVICFCLLGITCAIPVKQADSGSSEEKQ corresponding to amino acids 1-31 of OSTP_HUMAN (SEQ ID NO:552), which also corresponds to amino acids 1-31 of HUMOSTRO_PEA.sub.--1_PEA.sub.--1_P25 (SEQ ID NO:554), and a second amino acid sequence being at least 70%, optionally at least 80%, preferably at least 85%, more preferably at least 90% and most preferably at least 95% homologous to a polypeptide having the sequence H corresponding to amino acids 32-32 of HUMOSTRO_PEA.sub.--1_PEA.sub.--1_P25 (SEQ ID NO:554), wherein said first amino acid sequence and second amino acid sequence are contiguous and in a sequential order.

According to preferred embodiments of the present invention, there is provided an isolated chimeric polypeptide encoding for HUMOSTRO_PEA.sub.--1_PEA.sub.--1_P30 (SEQ ID NO:555), comprising a first amino acid sequence being at least 90% homologous to MRIAVICFCLLGITCAIPVKQADSGSSEEKQ corresponding to amino acids 1-31 of OSTP_HUMAN (SEQ ID NO:552), which also corresponds to amino acids 1-31 of HUMOSTRO_PEA.sub.--1_PEA.sub.--1_P30 (SEQ ID NO:555), and a second amino acid sequence being at least 70%, optionally at least 80%, preferably at least 85%, more preferably at least 90% and most preferably at least 95% homologous to a polypeptide having the sequence VSIFYVFI (SEQ ID NO:998) corresponding to amino acids 32-39 of HUMOSTRO_PEA.sub.--1_PEA.sub.--1_P30 (SEQ ID NO:555), wherein said first amino acid sequence and second amino acid sequence are contiguous and in a sequential order.

According to preferred embodiments of the present invention, there is provided an isolated polypeptide encoding for a tail of HUMOSTRO_PEA.sub.--1_PEA.sub.--1_P30 (SEQ ID NO:555), comprising a polypeptide being at least 70%, optionally at least about 80%, preferably at least about 85%, more preferably at least about 90% and most preferably at least about 95% homologous to the sequence VSIFYVFI (SEQ ID NO:998) in HUMOSTRO_PEA.sub.--1_PEA.sub.--1_P30 (SEQ ID NO:555).

According to preferred embodiments of the present invention, there is provided an isolated chimeric polypeptide encoding for T0888_PEA.sub.--1_P2 (SEQ ID NO:14), comprising a first amino acid sequence being at least 90% homologous to MGPPSAPPCRLHVPWKEVLLTASLLTFWNPPTTAKLTIESTPFNVAEGKEVLLLAHNLP QNRIGYSWYKGERVDGNSLIVGYVIGTQQATPGPAYSGRETIYPNASLLIQNVTQNDTG FYTLQVIKSDLVNEEATGQFHVYPELPKPSISSNNSNPVEDKDAVAFTCEPEVQNTTYL WWVNGQSLPVSPRLQLSNGNMTLTLLSVKRNDAGSYECEIQNPASANRSDPVTLNVLY GPDVPTISPSKANYRPGENLNLSCHMSNPPAQYSWFINGTFQQSTQELFIPNITVNNSGS YMCQAHNSATGLNRTTVTMITVS corresponding to amino acids 1-319 of CEA6_HUMAN (SEQ ID NO:13), which also corresponds to amino acids 1-319 of T10888_PEA.sub.--1_P2 (SEQ ID NO:14), and a second amino acid sequence being at least 70%, optionally at least 80%, preferably at least 85%, more preferably at least 90% and most preferably at least 95% homologous to a polypeptide having the sequence DWTRP (SEQ ID NO:999) corresponding to amino acids 320-324 of T10888_PEA.sub.--1_P2 (SEQ ID NO:14), wherein said first and second amino acid sequences are contiguous and in a sequential order.

According to preferred embodiments of the present invention, there is provided an isolated polypeptide encoding for a tail of T10888_PEA.sub.--1_P2 (SEQ ID NO:14), comprising a polypeptide being at least 70%, optionally at least about 80%, preferably at least about 85%, more preferably at least about 90% and most preferably at least about 95% homologous to the sequence DWTRP (SEQ ID NO:999) in T10888_PEA.sub.--1_P2 (SEQ ID NO:14).

According to preferred embodiments of the present invention, there is provided an isolated chimeric polypeptide encoding for T10888_PEA.sub.--1_P4 (SEQ ID NO:15), comprising a first amino acid sequence being at least 90% homologous to MGPPSAPPCRLHVPWKEVLLTASLLTFWNPPTTAKLTIESTPFNVAEGKEVLLLAHNLP QNRIGYSWYKGERVDGNSLIVGYVIGTQQATPGPAYSGRETIYPNASLLIQNVTQNDTG FYTLQVIKSDLVNEEATGQFHVYPELPKPSISSNNSNPVEDKDAVAFTCEPEVQNTTYL WWVNGQSLPVSPRLQLSNGNMTLTLLSVKRNDAGSYECEIQNPASANRSDPVTLNVL corresponding to amino acids 1-234 of CEA6_HUMAN (SEQ ID NO:13), which also corresponds to amino acids 1-234 of T10888_PEA.sub.--1_P4 (SEQ ID NO:15), and a second amino acid sequence being at least 70%, optionally at least 80%, preferably at least 85%, more preferably at least 90% and most preferably at least 95% homologous to a polypeptide having the sequence LLLSSQLWPPSASRLECWPGWL (SEQ ID NO:1000) corresponding to amino acids 235-256 of T10888_PEA.sub.--1_P4 (SEQ ID NO:15), wherein said first and second amino acid sequences are contiguous and in a sequential order.

According to preferred embodiments of the present invention, there is provided an isolated polypeptide encoding for a tail of T10888_PEA.sub.--1_P4 (SEQ ID NO:15), comprising a polypeptide being at least 70%, optionally at least about 80%, preferably at least about 85%, more preferably at least about 90% and most preferably at least about 95% homologous to the sequence LLLSSQLWPPSASRLECWPGWL (SEQ ID NO:1000) in T10888_PEA.sub.--1_P4 (SEQ ID NO:15).

According to preferred embodiments of the present invention, there is provided an isolated chimeric polypeptide encoding for T10888_PEA.sub.--1_P4 (SEQ ID NO:15), comprising a first amino acid sequence being at least 90% homologous to MGPPSAPPCRLHVPWKEVLLTASLLTFWNPPTTAKLTIESTPFNVAEGKEVLLLAHNLP QNRIGYSWYKGERVDGNSLIVGYVIGTQQATPGPAYSGRETIYPNASLLIQNVTQNDTG FYTLQVIKSDLVNEEATGQFHVYPELPKPSISSNNSNPVEDKDAVAFTCEPEVQNTTYL WWVNGQSLPVSPRLQLSNGNMTLTLLSVKRNDAGSYECEIQNPASANRSDPVTLNVL corresponding to amino acids 1-234 of Q13774, which also corresponds to amino acids 1-234 of T10888_PEA.sub.--1_P4 (SEQ ID NO:15), and a second amino acid sequence being at least 70%, optionally at least 80%, preferably at least 85%, more preferably at least 90% and most preferably at least 95% homologous to a polypeptide having the sequence LLLSSQLWPPSASRLECWPGWL (SEQ ID NO:1000) corresponding to amino acids 235-256 of T10888_PEA.sub.--1_P4 (SEQ ID NO:15), wherein said first and second amino acid sequences are contiguous and in a sequential order.

According to preferred embodiments of the present invention, there is provided an isolated polypeptide encoding for a tail of T10888_PEA.sub.--1_P4 (SEQ ID NO:15), comprising a polypeptide being at least 70%, optionally at least about 80%, preferably at least about 85%, more preferably at least about 90% and most preferably at least about 95% homologous to the sequence LLLSSQLWPPSASRLECWPGWL (SEQ ID NO:1000)in T10888_PEA.sub.--1_P4 (SEQ ID NO:15).

According to preferred embodiments of the present invention, there is provided an isolated chimeric polypeptide encoding for T10888_PEA.sub.--1_P5 (SEQ ID NO:16), comprising a first amino acid sequence being at least 90% homologous to MGPPSAPPCRLHVPWKEVLLTASLLTF-WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVYPELP-KPSISSNNSNPVEDKDAVAFTCEPEVQNTTYL WWVNGQSLPVSPRLQLSNGNMTLTLLS-VKRNDAGSYECEIQNPASANRSDPVTLNVLY GPDVP-TISPSKANYRPGENLNLSCHMSNP-PAQYSWFINGTFQQSTQELFIPNITVNNSGS YMCQAHNSATGLNRTTVTMITVSG corresponding to amino acids 1-320 of CEA6_HUMAN (SEQ ID NO:13), which also corresponds to amino acids 1-320 of T10888_PEA.sub.--1_P5 (SEQ ID NO:16), and a second amino acid sequence being at least 70%, optionally at least 80%, preferably at least 85%, more preferably at least 90% and most preferably at least 95% homologous to a polypeptide having the sequence KWIHEALASHFQVESGSQR-RARKKFSFPTCVQGAHANPKFSPEP-SQFTSADSFPLVFLFF VVFCFLISHV (SEQ ID NO:1001) corresponding to amino acids 321-390 of T10888_PEA.sub.--1_P5 (SEQ ID NO:16), wherein said first and second amino acid sequences are contiguous and in a sequential order.

According to preferred embodiments of the present invention, there is provided an isolated polypeptide encoding for a tail of T10888_PEA.sub.--1_P5 (SEQ ID NO:16), comprising a polypeptide being at least 70%, optionally at least about 80%, preferably at least about 85%, more preferably at least about 90% and most preferably at least about 95% homologous to the sequence TABLE-US-00078 KWIHEALASH-FQVESGSQRRARKKFSFPTCVQGAHANP-KFSPEPSQFTSADSFPLVFLFF (SEQ ID NO: 1001) VVFCFLISHV in T10888_PEA__1_P5. (SEQ ID NO: 16)

According to preferred embodiments of the present invention, there is provided an isolated chimeric polypeptide encoding for T10888_PEA.sub.--1_P6 (SEQ ID NO:17), comprising a first amino acid sequence being at least 90% homologous to TABLE-US-00079 MGPPSAPPCRLHVP-WKEVLLTASLLTFWNPPTTAKLTIEST-PFNVAEGKEVLLLA HNLPQNRIGYSW-YKGERVDGNSLIVGYVIGTQQATPGPAYSGRETIYPN ASLLIQNVTQ NDTGFYTLQVIKSDLVNEEATGQF-HVY corresponding to amino acids 1-141 of CEA6_HUMAN (SEQ ID NO:13), which also corresponds to amino acids 1-141 of T10888_PEA.sub.131_P6 (SEQ ID NO:17), and a second amino acid sequence being at least 70%, optionally at least 80%, preferably at least 85%, more preferably at least 90% and most preferably at least 95% homologous to a polypeptide having the sequence TABLE-US-00080 (SEQ ID NO: 1002) REYFHMTSGCWGSVLLPTYGIVR-PGLCLWPSLHYILYQGLDI corresponding to amino acids 142-183 of T10888_PEA.sub.--1P6 (SEQ ID NO:17), wherein said first and second amino acid sequences are contiguous and in a sequential order.

According to preferred embodiments of the present invention, there is provided an isolated polypeptide encoding for a tail of T10888_PEA.sub.--1_P6 (SEQ ID NO:17), comprising a polypeptide being at least 70%, optionally at least about 80%, preferably at least about 85%, more preferably at least about 90% and most preferably at least about 95% homologous to the sequence REYFHMTSGCWGSVLLPTYGIVR-PGLCLWPSLHYILYQGLDI (SEQ ID NO:1002) in T10888_PEA.sub.--1_P6 (SEQ ID NO:17.

According to preferred embodiments of the present invention, there is provided an isolated chimeric polypeptide encoding for T39971_P6 (SEQ ID NO:51), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQY-CYELDEKAVRPGYPKLIRDVWGIEGPI-DAAFTRINCQGKTYLFKGSQYWRFEDGV LDPDYPRNISDGFDGIPDNVDAALA-LPAHSYSGRERVYFFKG corresponding to amino acids 1-276 of VTNC_HUMAN, which also corresponds to amino acids 1-276 of T39971_P6 (SEQ ID NO:51), and a second amino acid sequence being at least 70%, optionally at least 80%, preferably at least 85%, more preferably at least 90% and most preferably at least 95% homologous to a polypeptide having the sequence TQGVVGD (SEQ ID NO:1003) corresponding to amino acids 277-283 of T39971_P6 (SEQ ID NO:51), wherein said first and second amino acid sequences are contiguous and in a sequential order.

According to preferred embodiments of the present invention, there is provided an isolated polypeptide encoding for a tail of T39971_P6 (SEQ ID NO:51), comprising a polypeptide being at least 70%, optionally at least about 80%, preferably at least about 85%, more preferably at least about 90% and most preferably at least about 95% homologous to the sequence TQGWGD (SEQ ID NO:1003) in T39971_P6 (SEQ ID NO:51).

According to preferred embodiments of the present invention, there is provided an isolated chimeric polypeptide encoding for T39971_P9 (SEQ ID NO:52), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQY-CYELDEKAVRPGYPKLIRDVWGIEGPID-MFTRINCQGKTYLFKGSQYWRFEDGV LDPDYPRNISDGFDGPDNVDAALALPAH-SYSGRERVYFFKGKQYWEYQFQHQPSQEE CEGSSL-SAVFEHFAMMQRDSWEDIFELLFWGRT corresponding to amino acids 1-325 of VTNC_HUMAN, which also corresponds to amino acids 1-325 of T39971_P9 (SEQ ID NO:52), and a second amino acid sequence being at least 90% homologous to SGMAPRPSLAKKQRFRHRNRKGYR-SQRGHSRGRNQNSRRPSRATWLSLFSSEESNLGA NNYDDYRMDWLVPATCEPIQSVFFFSGD-KYYRVNLRTRRVDTVDPPYPRSIAQYWLGC PAPGHL corresponding to amino acids 357-478 of VTNC_HUMAN, which also corresponds to amino acids 326-447 of T39971_P9 (SEQ ID NO:52), wherein said first and second amino acid sequences are contiguous and in a sequential order.

According to preferred embodiments of the present invention, there is provided an isolated chimeric polypeptide encoding for an edge portion of T39971_P9 (SEQ ID NO:52) comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TS, having a structure as follows: a sequence starting from any of amino acid numbers 325-x to 325; and ending at any of amino acid numbers 326+((n−2)-x), in which x varies from 0 to n−2.

According to preferred embodiments of the present invention, there is provided an isolated chimeric polypeptide encoding for T39971_P11 (SEQ ID NO:53), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQYCYELDEKAVRPGYPKLIRDVWGIEGPID-MFTRINCQGKTYLFKGSQYWRFEDGV LDPDYPRNISDGFDGIPDNVDAALA-LPAHSYSGRERVYFFKGKQYWEYQFQHPSQEE CEGSSLSAVFEHFAMMQRDSWEDIFELLFWGRTS corresponding to amino acids 1-326 of VTNC_HUMAN, which also corresponds to amino acids 1-326 of T39971_P11 (SEQ ID NO:53), and a second amino acid sequence being at least 90% homologous to DKYYRVNLRTRRVDTVDPPYPR-SIAQYWLGCPAPGHL corresponding to amino acids 442-478 of VTNC_HUMAN, which also corresponds to amino acids 327-363 of T39971_P11 (SEQ ID NO:53), wherein said first and second amino acid sequences are contiguous and in a sequential order.

According to preferred embodiments of the present invention, there is provided an isolated chimeric polypeptide encoding for an edge portion of T39971_P11 (SEQ ID NO:53), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326-x to 326; and ending at any of amino acid numbers 327+((n−2)-x), in which x varies from 0 to n−2.

According to preferred embodiments of the present invention, there is provided an isolated chimeric polypeptide encoding for T39971_P11 (SEQ ID NO:53), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQYCYELDEKAVRPGYPKLIRDVWGIEGPID-MFTRINCQGKTYLFKGSQYWRFEDGV LDPDYPRNISDGFDGIPDNVDMLALPAH-SYSGRERVYFFKGKQYWEYQFQHPSQEE CEGSSL-SAVFEHFAMMQRDSWEDIFELLFWGRTS corresponding to amino acids 1-326 of Q9BSH7, which also corresponds to amino acids 1-326 of T39971_P11 (SEQ ID NO:53), and a second amino acid sequence being at least 90% homologous to DKYYRVNLRTRRVDTVDPPYPRSIAQY-WLGCPAPGHL corresponding to amino acids 442-478 of Q9BSH7, which also corresponds to amino acids 327-363 of T39971_P11 (SEQ ID NO:53), wherein said first and second amino acid sequences are contiguous and in a sequential order.

According to preferred embodiments of the present invention, there is provided an isolated chimeric polypeptide encoding for an edge portion of T39971_P11 (SEQ ID NO:53), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326-x to 326; and ending at any of amino acid numbers 327+((n−2)-x), in which x varies from 0 to n−2.

According to preferred embodiments of the present invention, there is provided an isolated chimeric polypeptide encoding for T39971_P12 (SEQ ID NO:54), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQYCYELDEKAVRPGYPKLIRDVWGIEGPID-MFTRINCQGKTYLFK corresponding to amino acids 1-223 of VTNC_HUMAN, which also corresponds to amino acids 1-223 of T39971_P12 (SEQ ID NO:54), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO:1004) corresponding to amino acids 224-238 of T39971_P12 (SEQ ID NO:54 , wherein said first and second amino acid sequences are contiguous and in a sequential order.

According to preferred embodiments of the present invention, there is provided an isolated polypeptide encoding for a tail of T39971_P12 (SEQ ID NO:54), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO:1004) in T39971_P12 (SEQ ID NO:54) According to preferred embodiments of the present invention, there is provided an isolated chimeric polypeptide encoding for T39971_P12 (SEQ ID NO:54), comprising a first amino acid sequence being at least 90% homologous to MAPLRPLLILALLAWV-ALADQESCKGRCTEGFNVDKKC-QCDELCSYYQSCCTDYTAEC KPQVTRGDVFTM-PEDEYTVYDDGEEKNNATVHEQVGGPSLTSDLQAQ SKGNPEQTPV LKPEEEAPAPEVGASKPEGIDSRPETL-HPGRPQPPAEEELCSGKPFDAFTDLKNGSLFAFR GQYCYELDEKAVRPGYPKLIRDVWGIEG-PIDAAFTRINCQGKTYLFK corresponding to amino acids 1-223 of Q9BSH7, which also corresponds to amino acids 1-223 of T39971_P12 (SEQ ID NO:54), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO:1004) corresponding to amino acids 224-238 of T39971_P12 (SEQ ID NO:54), wherein said first and second amino acid sequences are contiguous and in a sequential order.

According to preferred embodiments of the present invention, there is provided an isolated polypeptide encoding for a tail of T39971_P12 (SEQ ID NO:54), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO:1004) in T39971_P12 (SEQ ID NO:54).

According to preferred embodiments of the present invention, there is provided an isolated chimeric polypeptide encoding for Z21368_PEA.sub.--1_P2 (SEQ ID NO:97), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSVV QAM-HEPRTFAVYLNNTGYRTAFFGKYLNEY-NGSYIPPGWREWLGLIKNSRFYNYTVCR NGIKEKHGFDYAKDYFTDLITNESINY-FKMSKRMYPHRPVMMVISHMPHGPEDSAPQ FSKLYPNASQHITPSYNYAPNMDKHWIM-QYTGPMLPIHMEFTNILQRKRLQTLMSVDD SVER-LYNMLVETGELENTYIIYTADHGY-HIGQFGLVKGKSMPYDFDIRVPFFIRGPSVEP GSIVPQIVLNIDLAPTILDIAGLDTPPD-VDGKSVLKLLDPEKPGNRFRTNKKAKIWRDTFL VERGKFLRKKEESSKNIQQSNHLPKY-ERVKELCQQARYQTACEQPGQKWQCIEDTSGK LRI-HKCKGPSDLLTVRQSTRNLYARGFHDKD-KECSCRESGYRASRSQRKSQRQFLRNQ GTPKYKPRFVHTRQTRSLSVEFEGEIY-DINLEEEEELQVLQPRNIAKRHDEGHKGPRDLQ ASSGGNRGRMLADSSNAVGPPTTVRVTH-KCFILPNDSIHCERELYQSARAWKDHKAYI DKEIEALQDKIKNLREVRGHLKRRK-PEECSCSKQSYYNKEKGVKKQEKLKSHLHPFKE AAQEVDSKLQLFKENNRRRK-KERKEKRRQRKGEECSLPGLTCFTHDN-NHWQTAPFWN corresponding to amino acids 1-761 of SUL1_HUMAN, which also corresponds to amino acids 1-761 of Z21368_PEA.sub.--1_P2 (SEQ ID NO:97), and a second amino acid sequence being at least 70%, optionally at least 80%, preferably at least 85%, more preferably at least 90% and most preferably at least 95% homologous to a polypeptide having the sequence PHKYSAHGRTRHFESA-TRTTNGAQKLSRI (SEQ ID NO:1005) corresponding to amino acids 762-790 of Z21368_PEA.sub.--1_P2 (SEQ ID NO:97), wherein said first and second amino acid sequences are contiguous and in a sequential order.

According to preferred embodiments of the present invention, there is provided an isolated polypeptide encoding for a tail of Z21368_PEA.sub.--1_P2 (SEQ ID NO:97), comprising a polypeptide being at least 70%, optionally at least about 80%, preferably at least about 85%, more preferably at least about 90% and most preferably at least about 95% homologous to the sequence PHKYSAHGRTRHFESATRTT-NGAQKLSRI (SEQ ID NO:1005) in Z21368_PEA.sub.--1_P2 (SEQ ID NO:97).

According to preferred embodiments of the present invention, there is provided an isolated chimeric polypeptide encoding for Z21368_PEA.sub.--1_P5 (SEQ ID NO:98), comprising a first amino acid sequence being at least 90% homologous to MKYSCCALVLAVLGTELLGSLCSTVR-SPRFRGRIQQERKNIILVLTDDQDVEL corresponding to amino acids 1-57 of Q7Z2W2 (SEQ ID NO:840), which also corresponds to amino acids 1-57 of Z21368_PEA.sub.--1_P5 (SEQ ID NO:98), second bridging amino acid sequence comprising A, and a third amino acid sequence being at least 90% homologous to FFGKYLNEY-NGSYIPPGWREWLGLIKNSRFYNY-TVCRNGIKEKHGFDYAKDYFTDLITN ESINYFKM-SKRMYPHRPVMMVISHMPHGPEDSAPQFSKLYPNA SQHITPSYNYAPNM DKHWIMQYTGPMLPIHMEFT-NILQRKRLQTLMSVDDSVERLYNMLVET-GELENTYIIYT ADHGYHIGQFGLVKGKSMPYD-FDIRVPFFIRGPSVEPGSIVPQIVLNIDLAPTILDIAGLDT PPDVDGKSVLKLLDPEKPGNRFRT-NKKAKIWRDTFLVERGKFLRKKEESSKNIQQSNHL PKYERVKELCQQARYQTACEQPGQK-WQCIEDTSGKLRIHKCKGPSDLLTVRQSTRNLY ARG-FHDKDKECSCRESGYRASRSQRKSQRQ-FLRNQGTPKYKPRFVHTRQTRSLSVEFE GEIYDINLEEEEELQVLQPRNIAKRHDE-GHKGPRDLQASSGGNRGRMLADSSNAVGPPT TVRVTHKCFILPNDSIHCERELYQSA-RAWKDHKAYIDKEIEALQDKIKNLREVRGHLKR RKPEECSCSKQSYYNKEKGVKKQEKLK-SHLHPFKEMQEVDSKLQLFKENNRRRKKER KEKRRQRKGEECSLPGLTCFTHDN-NHWQTAPFWNLGSFCACTSSNNNTYWCLRTVNE THNFLFCEFATGFLEYFDMNTDPYQLT-NTVHTVERGILNQLHVQLMELRSCQGYKQCN PRP-KNLDVGNKDGGSYDLHRGQLWDGWEG corresponding to amino acids 139-871 of Q7Z2W2 (SEQ ID NO:840), which also corresponds to amino acids 59-791 of Z21368_PEA.sub.--1_P5 (SEQ ID NO:98), wherein said first, second and third amino acid sequences are contiguous and in a sequential order.

According to preferred embodiments of the present invention, there is provided an isolated polypeptide encoding for an edge portion of Z21368_PEA.sub.--1_P5 (SEQ ID NO:98), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least three amino acids comprise LAF having a structure as follows (numbering according to Z21368_PEA.sub.--1_P5 (SEQ ID NO:98) ): a sequence starting from any of amino acid numbers 57—x to 57; and ending at any of amino acid numbers 59+((n−2)-x), in which x varies from 0 to n−2.

According to preferred embodiments of the present invention, there is provided an isolated chimeric polypeptide encoding for Z21368_PEA.sub.--1_P5 (SEQ ID NO:98), comprising a first amino acid sequence being at least 70%, optionally at least 80%, preferably at least 85%, more preferably at least 90% and most preferably at least 95% homologous to a polypeptide having the sequence MKYSCCAL VLAVLGTELLGSLCSTVRSPRFR-GRIQQERKNIRPNIILVLTDDQDVELAFF GKYLNEY-NGSYIPPGWREWLGLIKNSRFYNY-TVCRNGIKEKHGFDYAKDYFTDLITNES INYFKMSKRMYPHRPVMMVISHAAPHG-PEDSAPQFSKLYPNASQHITPSYNYAPNMDK HWIM-QYTGPMLPIHMEFTNILQRKRLQTLMS-VDDSVERLYNMLVETGELENTYIIYTAD HGYHIGQFGLVKGKSMPYD-FDIRVPFFIRGPSVEPGSIVPQIVLNID-LAPTILDIAGLDTPP DVDGKSVLKLLDPEKPGNRFRT-NKKAKIWRDTFLVERGKFLRKKEESSKNIQQSNHLP KYERVKELCQQARYQTACEQPGQK-WQCIEDTSGKLRIHKCKGPSDLLTVRQSTRNLYA RGFHDKDKECSCRESGYRASRSQRK-SQRQFLRNQGTPKYKPRFVHTRQTRSLSVEFEGE IYDINLEEEEELQVLQPRNIAKRHDEGH-KGPRDLQASSGGNRGRMLADSSNAVGPPTTV RVTH-KCFILPNDSIHCERELYQSARAWKDH-KAYIDKEIEALQDKIKNLREVRGHLKRRK PEECSCSKQSYYNKEKGVKKQEKLKSHL-HPFKEMQEVDSKLQLFKENNRRRKKERKE KRRQRKGEECSLPGLTCFTHDN-NHWQTAPFWNLGSFCACTSSNNNTYWCLRTVNETH NFLFCEFATGFLEYFDMNTDPYQLT-NTVHTVERGILNQLHVQLME (SEQ ID NO:1006) corresponding to amino acids 1-751 of Z21368_PEA.sub.--1_P5 (SEQ ID NO:98), and a second amino acid sequence being at least 90% homologous to LRSCQGYKQCNPRPKNLD-VGNKDGGSYDLHRGQLWDGWEG corresponding to amino acids 1-40 of MH12997 (SEQ ID NO:841), which also corresponds to amino acids 752-791 of Z21368_PEA.sub.--1_P5 (SEQ ID NO:98), wherein said first and second amino acid sequences are contiguous and in a sequential order.

According to preferred embodiments of the present invention, there is provided an isolated polypeptide encoding for a head of Z21368_PEA.sub.--1_P5 (SEQ ID NO:98), comprising a polypeptide being at least 70%, optionally at least about 80%, preferably at least about 85%, more preferably at least about 90% and most preferably at least about 95% homologous to the sequence TABLE-US-00081 MKYSCCALV-LAVLGTELLGSLCSTVRSPRFR-GRIQQERKNIRPNIILVLTDDQDVELAFF (SEQ ID NO: 1006) GKYLNEYNGSYIPPGWREWLGLIKNSR-FYNYTVCRNGIKEKHGFDYAKDYFTDLITNES INY-FKMSKRMYPHRPVMMVISHMPHGPED-SAPQFSKLYPNASQHITPSYNYAPNMDK HWIMQYTGPMLPIHMEFT-NILQRKRLQTLMSVDDSVERLYNMLVET-GELENTYIIYTAD HGYHIGQFGLVKGKSMPYD-FDIRVPFFIRGPSVEPGSIVPQIVLNIDLAPTILDIAGL DTPP DVDGKSVLKLLDPEKPGNRFRTNKKAKI-WRDTFLVERGKFLRKKEESSKNIQQSNHLP KYERVKELCQQARYQTACEQPGQK-WQCIEDTSGKLRIHKCKGPSDLLTVRQSTRNLYA RGFHDKDKECSCRESGYRASRSQRK-SQRQFLRNQGTPKYKPRFVHTRQTRSLSVEFEGE IYDINLEEEEELQVLQPRNIAKRHDEGH-KGPRDLQASSGGNRGRMLADSSNAVGPPTTV RVTH-KCFILPNDSIHCERELYQSARAWKDH-KAYIDKEIEALQDKIKNLREVRGHLKRRK PEECSCSKQSYYNKEKGVKKQEKLKSHL-HPFKEMQEVDSKLQLFKENNRRRKKERKE KRRQRKGEECSLPGLTCFTHDN-NHWQTAPFWNLGSFCACTSSNNNTYWCLRTVNETH NFLFCEFATGFLEYFDMNTDPYQLT-NTVHTVERGILNQLHVQLME of Z21368_PEA__1_P5. (SEQ ID NO: 98)

According to preferred embodiments of the present invention, there is provided an isolated chimeric polypeptide encoding for Z21368_PEA.sub.--1_P5 (SEQ ID NO:98), comprising a first amino acid sequence being at least 90% homologous to MKYSCCALVLAVLGTELLGSLCSTVR-SPRFRGRIQQERKNIRPNIILVLTDDQDVEL corresponding to amino acids 1-57 of SUL1_HUMAN, which also corresponds to amino acids 1-57 of Z21368_PEA.sub.--1_P5 (SEQ ID NO:98), and a second amino acid sequence being at least 90% homologous to AFFGKYLNEYNGSYIPPG-WREWLGLIKNSRFYNYTVCRNGIKEKHG-FDYAKDYFTDLIT NESINYFKMSKRMYPHRPVMMV-ISHMPHGPEDSAPQFSKLYPNASQHITPSYNYAPN MDKHWIMQYTGPMLPIHMEFT-NILQRKRLQTLMSVDDSVERLYNMLVETGELENTYII YTADHGYHIGQFGLVKGKSMPYD-FDIRVPFFIRGPSVEPGSIVPQIVLNIDLAPTILDIAGL DTPPDVDGKSVLKLLDPEKPGNRFRT-NKKAKIWRDTFLVERGKFLRKKEESSKNIQQSN HLP-KYERVKELCQQARYQTACEQPGQK-WQCIEDTSGKLRIHKCKGPSDLLTVRQSTRN LYARGFHDKDKECSCRESGYRASRSQRK-SQRQFLRNQGTPKYKPRFVHTRQTRSLSVE FEGEIY-DINLEEEEELQVLQPRNIAKRHDEGHKG-PRDLQASSGGNRGRMLADSSNAVGP PTTVRVTHKCFILPNDSIHCERELYQSA-RAWKDHKAYIDKEIEALQDKIKNLREVRGHL KRRK-PEECSCSKQSYYNKEKGVKKQEKLKSHL-HPFKEMQEVDSKLQLFKENNRRRK KERKEKRRQRKGEECSLPGLTCFTHDN-NHWQTAPFWNLGSFCACTSSNNNTYWCLRT VNETHNFLFCEFATGFLEYFDMNTD-PYQLTNTVHTVERGILNQLHVQLMELRSCQGYK QCNPRPKNLDVGNKDGGSYDLHRGQLWDGWEG corresponding to amino acids 138-871 of SUL1_HUMAN, which also corresponds to amino acids 58-791 of Z21368_PEA.sub.--1_P5 (SEQ ID NO:98), wherein said first and second amino acid sequences are contiguous and in a sequential order.

According to preferred embodiments of the present invention, there is provided an isolated chimeric polypeptide encoding for an edge portion of Z21368_PEA.sub.--1_P5 (SEQ ID NO:98), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LA, having a structure as follows: a sequence starting from any of amino acid numbers 57-x to 57; and ending at any of amino acid numbers 58+((n−2)-x), in which x varies from 0 to n−2.

According to preferred embodiments of the present invention, there is provided an isolated chimeric polypeptide encoding for Z21368_PEA.sub.--1_P15 (SEQ ID NO:99), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSVV QAM-HEPRTFAVYLNNTGYRTAFFGKYLNEY-NGSYIPPGWREWLGLIKNSRFYNYTVCR NGIKEKHGFDYAKDYFTDLITNESINY-FKMSKRMYPHRPVMMVISHMPHGPEDSAPQ FSKLYPNASQHITPSYNYAPNMDKHWIM-QYTGPMLPIHMEFTNILQRKRLQTLMSVDD SVER-LYNMLVETGELENTYIIYTADHGY-HIGQFGLVKGKSMPYDFDIRVPFFIRGPSVEP GSIVPQIVLNIDLAPTILDIAGLDTPPD-VDGKSVLKLLDPEKPGNRFRTNKKAKI-WRDTFLVERG corresponding to amino acids 1-416 of SUL1L_HUMAN, which also corresponds to amino acids 1-416 of Z21368_PEA.sub.--1_P15 (SEQ ID NO:99).

According to preferred embodiments of the present invention, there is provided an isolated chimeric polypeptide encoding for Z21368_PEA.sub.--1_P16 (SEQ ID NO:100), comprising a first amino acid sequence being at least 90% homologous to MKYSCCALVLAVLGTELLGSLCSTVRSPRFRGRIQQERKNIRPNIILVLTDDQDVELGSL QVMNKTRKIMEHGGATFINAFVTTPMC-CPSRSSMLTGKYVHNHNVYTNNENCSSPSVV QAMHEPRTFAVYLNNTGYRTAFFGKYLNEY-NGSYIPPGWREWLGLIKNSRFYNYTVCR NGIKEKHGFDYAKDYFTDLITNESINY-FKMSKRMYPHRPVMMVISHMPHGPEDSAPQ FSKLYPNASQHITPSYNYAPNMDKHWIM-QYTGPMLPIHMEFTNILQRKRLQTLMSVDD SVER-LYNMLVETGELENTYIIYTADHGY-HIGQFGLVKGKSMPYDFDIRVPFFIRGPSVEP GSIVPQIVLNIDLAPTILDIAGLDTPPD-VDGKSVLKLLDPEKPGNR corresponding to amino acids 1-397 of SUL1_HUMAN, which also corresponds to amino acids 1-397 of Z21368_PEA.sub.--1_P16 (SEQ ID NO:100), and a second amino acid sequence being at least 70%, optionally at least 80%, preferably at least 85%, more preferably at least 90% and most preferably at least 95% homologous to a polypeptide having the sequence CVIVPPLSQPQIH (SEQ ID NO:1007) corresponding to amino acids 398-410 of Z21368_PEA.sub.--1_P16 (SEQ ID NO:100), wherein said first and second amino acid sequences are contiguous and in a sequential order.

According to preferred embodiments of the present invention, there is provided an isolated polypeptide encoding for a tail of Z21368_PEA.sub.--1_P16 (SEQ ID NO:100), comprising a polypeptide being at least 70%, optionally at least about 80%, preferably at least about 85%, more preferably at least about 90% and most preferably at least about 95% homologous to the sequence CVIVPPLSQPQIH (SEQ ID NO:1007) in Z21368_PEA.sub.--1-P16 (SEQ ID NO:100).

According to preferred embodiments of the present invention, there is provided an isolated chimeric polypeptide encoding for Z21368_PEA.sub.--1_P22 (SEQ ID NO:101), comprising a first amino acid sequence being at least 90% homologous to MKYSCCALVLAVLGTELLGSLCSTVRSPRFRGRIQQERKNIRPNIILVLTDDQDVELGSL QVMNKTRKIMEHGGATFINAFVTTPMC-CPSRSSMLTGKYVHNHNVYTNNENCSSPSVV QAMHEPRTFAVYLNNTGYRTAFFGKYLNEY-NGSYIPPGWREWLGLIKNSRFYNYTVCR NGIKEKHGFDYAK corresponding to amino acids 1-188 of SUL1_HUMAN, which also corresponds to amino acids 1-188 of Z21368_PEA.sub.--1_P22 (SEQ ID NO:101), and a second amino acid sequence being at least 70%, optionally at least 80%, preferably at least 85%, more preferably at least 90% and most preferably at least 95% homologous to a polypeptide having the sequence ARYDGDQPRCAPRPRGLSPTVF (SEQ ID NO:1008) corresponding to amino acids 189-210 of Z21368_PEA.sub.--1_P22 (SEQ ID NO: 101), wherein said first and second amino acid sequences are contiguous and in a sequential order.

According to preferred embodiments of the present invention, there is provided an isolated polypeptide encoding for a tail of Z21368_PEA.sub.--1_P22 (SEQ ID NO:101), comprising a polypeptide being at least 70%, optionally at least about 80%, preferably, at least about 85%, more preferably at least about 90% and most preferably at least about 95% homologous to the sequence ARYDGDQPRCAPRPRGLSPTVF (SEQ ID NO:1008) in Z21368_PEA.sub.--1P22 (SEQ ID NO:101).

According to preferred embodiments of the present invention, there is provided an isolated chimeric polypeptide encoding for Z21368_PEA.sub.--1_P23 (SEQ ID NO:102), comprising a first amino acid sequence being at least 90% homologous to MKYSCCALVLAVLGTELLGSLCSTVRSPRFRGRIQQERKNIRPNIILVLTDDQDVELGSL QVMNKTRKIMEHGGATFINAFVTTPMC-CPSRSSMLTGKYVHNHNVYTNNENCSSPSVV QAMHEPRTFAVYLNNTGYRT corresponding to amino acids 1-137 of Q7Z2W2 (SEQ ID NO:840), which also corresponds to amino acids 1-137 of Z21368_PEA.sub.--1_P23 (SEQ ID NO:102), and a second amino acid sequence being at least 70%, optionally at least 80%, preferably at least 85%, more preferably at least 90% and most preferably at least 95% homologous to a polypeptide having the sequence GLLHRLNH (SEQ ID NO:1009) corresponding to amino acids 138-145 of Z21368_PEA.sub.--1_P23 (SEQ ID NO:102), wherein said first and second amino acid sequences are contiguous and in a sequential order.

According to preferred embodiments of the present invention, there is provided an isolated polypeptide encoding for a tail of Z21368_PEA.sub.--1_P23 (SEQ ID NO:102), comprising a polypeptide being at least 70%, optionally at least about 80%, preferably at least about 85%, more preferably at least about 90% and most preferably at least about 95% homologous to the sequence GLLHRLNH (SEQ ID NO:1009) in Z21368_PEA.sub.--1_P23 (SEQ ID NO:102).

According to preferred embodiments of the present invention, there is provided an isolated chimeric polypeptide encoding for Z21368_PEA.sub.--1_P23 (SEQ ID NO:102), comprising a first amino acid sequence being at least 90% homologous to MKYSCCALVLAVLGTELLGSLCSTVRSPRFRGRIQQERKNIRPNIILVLTDDQDVELGSL QVMNKTRKIMEHGGATFINAFVTTPMC-CPSRSSMLTGKYVHNHNVYTNNENCSSPSVV QAMHEPRTFAVYLNNTGYRT corresponding to amino acids 1-137 of SUL1_HUMAN, which also corresponds to amino acids 1-137 of Z21368_PEA.sub.--1_P23 (SEQ ID NO:102), and a second amino acid sequence being at least 70%, optionally at least 80%, preferably at least 85%, more preferably at least 90% and most preferably at least 95% homologous to a polypeptide having the sequence GLLHRLNH (SEQ ID NO:1009) corresponding to amino acids 138-145 of Z21368 PEA.sub.--1_P23 (SEQ ID NO:102), wherein said first and second amino acid sequences are contiguous and in a sequential order.

According to preferred embodiments of the present invention, there is provided an isolated polypeptide encoding for a tail of Z21368_PEA.sub.--1_P23 (SEQ ID NO:102), comprising a polypeptide being at least 70%, optionally at least about 80%, preferably at least about 85%, more preferably at least about 90% and most preferably at least about 95% homologous to the sequence GLLHRLNH (SEQ ID NO:1009) in Z21368_PEA.sub.--1_P23 (SEQ ID NO:102).

According to preferred embodiments of the present invention, there is provided an isolated chimeric polypeptide encoding for T59832_P5 (SEQ ID NO:143), comprising a first amino acid sequence being at least 90% homologous to MTLSPLLLFLPPLLLLLDVPTMVQAS-PLQALDFFGNGPPVNYK corresponding to amino acids 12-55 of GILT_HUMAN (SEQ ID NO:142), which also corresponds to amino acids 1-44 of T59832_P5 (SEQ ID NO:143), and a second amino acid sequence being at least 70%, optionally at least 80%, preferably at least 85%, more preferably at least 90% and most preferably at least 95% homologous to a polypeptide having the sequence VGTATGRAGWREQAPCRGTRLLLSPQTSQGK- TRAPRGRCPCRVPGKTLFSSRRCGHTP SVPFRFRIPH-
LRGAAASTRLVPPKGSMSAYCVLLGQELGSPFVAQG
TSSMGQGPPACIL AATLDAFIPARAGLA-
CLWDLLGRCPRG (SEQ ID NO:1010) corresponding to amino acids 45-189 of T59832_P5 (SEQ ID NO:143), wherein said first and second amino acid sequences are contiguous and in a sequential order.

According to preferred embodiments of the present invention, there is provided an isolated polypeptide encoding for a tail of T59832_P5 (SEQ ID NO:143), comprising a polypeptide being at least 70%, optionally at least about 80%, preferably at least about 85%, more preferably at least about 90% and most preferably at least about 95% homologous to the sequence TABLE-US-00082 VGTATGRAG-WREQAPCRGTRLLLSPQTSQGKTRA-
PRGRCPCRVPGKTLFSSRRCGHTP (SEQ ID NO: 1010) SVPFRFRIPHLRGAAASTRLVPPKGSM-
SAYCVLLGQELGSPFVAQGTSSAAGQGPPACIL
AATLDAFIPARAGLACLWDLLGRCPRG in T59832_P5. (SEQ ID NO: 143)

According to preferred embodiments of the present invention, there is provided an isolated chimeric polypeptide encoding for T59832_P7 (SEQ ID NO:144), comprising a first amino acid sequence being at least 90% homologous to MTLSPLLLFLPPLLLLLDVPTMVQAS-
PLQALDFFGNGPPVNYKTGNLYLRGPLKKSNA
PLVNVTLYYEALCGGCRAFLIRELF-
PTWLLVMEILNVTLVPYGNAQEQNVSGRWEFKC
QHGEEECKFNKVEACVLDELD-
MELAFLTIVCMEEFEDMERSLPLCLQ-
LYAPGLSPDTIM ECAMGDRGMQLMHANAQRT-
DALQPPHEYVPWVTVNG corresponding to amino acids 12-223 of GILT_HUMAN (SEQ ID NO:142), which also corresponds to amino acids 1-212 of T59832_P7 (SEQ ID NO:144), and a second amino acid sequence being at least 70%, optionally at least 80%, preferably at least 85%, more preferably at least 90% and most preferably at least 95% homologous to a polypeptide having the sequence VRIFLA-LSLTLIVPWSQGWTRQRDQR (SEQ ID NO:1011) corresponding to amino acids 213-238 of T59832_P7 (SEQ ID NO:144), wherein said first and second amino acid sequences are contiguous and in a sequential order.

According to preferred embodiments of the present invention, there is provided an isolated polypeptide encoding for a tail of T59832_P7 (SEQ ID NO:144), comprising a polypeptide being at least 70%, optionally at least about 80%, preferably at least about 85%, more preferably at least about 90% and most preferably at least about 95% homologous to the sequence VRIFLALSLTLIVPWSQGWTRQRDQR (SEQ ID NO:1011) in T59832_P7 (SEQ ID NO:144).

According to preferred embodiments of the present invention, there is provided an isolated chimeric polypeptide encoding for T59832_P7 (SEQ ID NO:144), comprising a first amino acid sequence being at least 90% homologous to MTLSPLLLFLPPLLLLLDVPTAAVQAS-
PLQALDFFGNGPPVNYKTGNLYLRGPLKKSNA
PLVNVTLYYEALCGGCRAFLIRELF-
PTWLLVMEILNVTLVPYGNAQEQNVSGRWEFKC
QHGEEECKFNKVEACVLDELD-
MELAFLTIVCMEEFEDMERSLPLCLQ-
LYAPGLSPDTIM ECAMGDRGMQLMHANAQRT-
DALQPPHEYVPWVTVNG corresponding to amino acids 1-212 of BAC98466 (SEQ ID NO:848), which also corresponds to amino acids 1-212 of T59832_P7 (SEQ ID NO:144), and a second amino acid sequence being at least 70%, optionally at least 80%, preferably at least 85%, more preferably at least 90% and most preferably at least 95% homologous to a polypeptide having the sequence VRIFLA-LSLTLIVPWSQGWTRQRDQR (SEQ ID NO:1011) corresponding to amino acids 213-238 of T59832_P7 (SEQ ID NO:144), wherein said first and second amino acid sequences are contiguous and in a sequential order.

According to preferred embodiments of the present invention, there is provided an isolated polypeptide encoding for a tail of T59832_P7 (SEQ ID NO:144), comprising a polypeptide being at least 70%, optionally at least about 80%, preferably at least about 85%, more preferably at least about 90% and most preferably at least about 95% homologous to the sequence VRIFLALSLTLIVPWSQGWTRQRDQR (SEQ ID NO:1011) in T59832 P7 (SEQ ID NO:144).

According to preferred embodiments of the present invention, there is provided an isolated chimeric polypeptide encoding for T59832_P7 (SEQ ID NO:144), comprising a first amino acid sequence being at least 70%, optionally at least 80%, preferably at least 85%, more preferably at least 90% and most preferably at least 95% homologous to a polypeptide having the sequence MTLSPLLLFLPPLLLLL-
DVPTMVQASPLQALDFFGNGPPVNYKT-
GNLYLRGPLKKSNA PLVNVTLYYEALCGGCRAF-
LIRELFPTWLLV (SEQ ID NO:1012) corresponding to amino acids 1-90 of T59832_P7 (SEQ ID NO:144), and a second amino acid sequence being at least 90% homologous to MEILNVTLVPYGNAQEQNVSGRWEFKC-
QHGEEECKFNKVEACVLDELDMELAFLTIVC
MEEFEDMERSLPLCLQLYAPGLSPD-
TIMECAMGDRGMQLMHANAQRTDALQPPHEYV
PWVTVNGVRIFLALSLTLIVPWSQGWTRQRDQR corresponding to amino acids 1-148 of BAC85622 (SEQ ID NO:849), which also corresponds to amino acids 91-238 of T59832_P7 (SEQ ID NO:144), wherein said first and second amino acid sequences are contiguous and in a sequential order.

According to preferred embodiments of the present invention, there is provided an isolated polypeptide encoding for a head of T59832_P7 (SEQ ID NO:144), comprising a polypeptide being at least 70%, optionally at least about 80%, preferably at least about 85%, more preferably at least about 90% and most preferably at least about 95% homologous to the sequence TABLE-US-00083 MTLSPLLLFLPPLLLLL-
DVPTAAVQASPLQALDFFGNGPPVNYKT-
GNLYLRGPLKKSNA (SEQ ID NO: 1012) PLVNVTLY-YEALCGGCRAFLIRELFPTWLLV of T59832_P7. (SEQ ID NO: 144)

According to preferred embodiments of the present invention, there is provided an isolated chimeric polypeptide encoding for T59832_P7 (SEQ ID NO:144), comprising a first amino acid sequence being at least 90% homologous to MTLSPLLLFLPPLLLLLDVPTAAVQAS-
PLQALDFFGNGPPVNYKTGNLYLRGPLKKSNA
PLVNVTLYYEALCGGCRAFLIRELF-
PTWLLVMEILNVTLVPYGNAQEQNVSGRWEFKC
QHGEEECKFNKVEACVLDELD-
MELAFLTIVCMEEFEDMERSLPLCLQ-
LYAPGLSPDTIM ECAMGDRGMQLMHANAQRT-
DALQPPHEYVPWVTVNG corresponding to amino acids 1-212 of Q8WU77 (SEQ ID NO:850), which also corresponds to amino acids 1-212 of T59832_P7 (SEQ ID NO:144), and a second amino acid sequence being at least 70%, optionally at least 80%, preferably at least 85%, more preferably at least 90% and most preferably at least 95% homologous to a polypeptide having the sequence VRIFLA-LSLTLIVPWSQGWTRQRDQR (SEQ ID NO:1011) corresponding to amino acids 213-238 of T59832_P7 (SEQ ID NO:144), wherein said first and second amino acid sequences are contiguous and in a sequential order.

According to preferred embodiments of the present invention, there is provided an isolated polypeptide encoding for a tail of T59832_P7 (SEQ ID NO:144), comprising a polypeptide being at least 70%, optionally at least about 80%, preferably at least about 85%, more preferably at least about 90% and most preferably at least about 95% homologous to the sequence VRIFLALSLTLIVPWSQGWTRQRDQR (SEQ ID NO:1011) in T59832_P7 (SEQ ID NO:144).

According to preferred embodiments of the present invention, there is provided an isolated chimeric polypeptide encoding for T59832_P9 (SEQ ID NO:145), comprising a first amino acid sequence being at least 90% homologous to MTLSPLLLFLPPLLLLLDVPTMVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHE corresponding to amino acids 12-214 of GILT_HUMAN (SEQ ID NO:142), which also corresponds to amino acids 1-203 of T59832_P9 (SEQ ID NO:145), and a second amino acid sequence being at least 70%, optionally at least 80%, preferably at least 85%, more preferably at least 90% and most preferably at least 95% homologous to a polypeptide having the sequence NPWKIRPSSLPLSASC-TRARSRMSALPQPAPSGVFASSDGR (SEQ ID NO:1013) corresponding to amino acids 204-244 of T59832_PP9 (SEQ ID NO:145), wherein said first and second amino acid sequences are contiguous and in a sequential order.

According to preferred embodiments of the present invention, there is provided an isolated polypeptide encoding for a tail of T59832_P9 (SEQ ID NO:145), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQ-PAPSGVFASSDGR (SEQ ID NO:1013) in T59832_PP9 (SEQ ID NO:145).

According to preferred embodiments of the present invention, there is provided an isolated chimeric polypeptide encoding for T59832_P9 (SEQ ID NO:145), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHE corresponding to amino acids 1-203 of BAC98466 (SEQ ID NO:848), which also corresponds to amino acids 1-203 of T59832_P9 (SEQ ID NO:145), and a second amino acid sequence being at least 70%, optionally at least 80%, preferably at least 85%, more preferably at least 90% and most preferably at least 95% homologous to a polypeptide having the sequence NPWKIRPSSLPLSASC-TRARSRMSALPQPAPSGVFASSDGR (SEQ ID NO: 1013) corresponding to amino acids 204-244 of T59832 P9 (SEO ID NO:145), wherein said first and second amino acid sequences are contiguous and in a sequential order.

According to preferred embodiments of the present invention, there is provided an isolated polypeptide encoding for a tail of T59832_P9 (SEQ ID NO: 145), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQ-PAPSGVFASSDGR (SEQ ID NO:1013) in T59832_PP9 (SEQ ID NO:145).

According to preferred embodiments of the present invention, there is provided an isolated chimeric polypeptide encoding for T59832_P9 (SEQ ID NO:145), comprising a first amino acid sequence being at least 70%, optionally at least 80%, preferably at least 85%, more preferably at least 90% and most preferably at least 95% homologous to a polypeptide having the sequence MTLSPLLLFLPPLLLLL-DVPTAAVQASPLQALDFFGNGPPVNYKT-GNLYLRGPLKKSNA PLVNVTLYYEALCGGCRAF-LIRELFPTWLLV (SEQ ID NO:1012) corresponding to amino acids 1-90 of T59832_P9 (SEQ ID NO:145), second amino acid sequence being at least 90% homologous to MEILNVTLVPYGNAQEQNVSGRWEFKC-QHGEEECKFNKVEACVLDELDMELAFLTIVC MEEFEDMERSLPLCLQLYAPGLSPD-TIMECAMGDRGMQLMHANAQRTDALQPPHE corresponding to amino acids 1-113 of BAC85622 (SEQ ID NO:849), which also corresponds to amino acids 91-203 of T59832_P9 (SEQ ID NO:145), and a third amino acid sequence being at least 70%, optionally at least 80%, preferably at least 85%, more preferably at least 90% and most preferably at least 95% homologous to a polypeptide having the sequence NPWKIRPSSLPLSASCTRARSRMSALPQ-PAPSGVFASSDGR (SEQ ID NO:1013) corresponding to amino acids 204-244 of T59832_P9 (SEQ ID NO:145), wherein said first, second and third amino acid sequences are contiguous and in a sequential order.

According to preferred embodiments of the present invention, there is provided an isolated polypeptide encoding for a head of T59832_P9 (SEQ ID NO:145), comprising a polypeptide being at least 70%, optionally at least about 80%, preferably at least about 85%, more preferably at least about 90% and most preferably at least about 95% homologous to the sequence TABLE-US-00084 MTLSPLLLFLPPLLLLL-DVPTAAVQASPLQALDFFGNGPPVNYKT-GNLYLRGPLKKSNA (SEQ ID NO: 1012) PLVNVTLY-YEALCGGCRAFLIRELFPTWLLV of T59832 P9. (SEQ ID NO: 145)

According to preferred embodiments of the present invention, there is provided an isolated polypeptide encoding for a tail of T59832_P9 (SEQ ID NO:145), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQ-PAPSGVFASSDGR (SEQ ID NO:1013) in T59832_P9 (SEQ ID NO:145).

According to preferred embodiments of the present invention, there is provided an isolated chimeric polypeptide encoding for T59832_P9 (SEQ ID NO:145), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHE corresponding to amino acids 1-203 of Q8WU77 (SEQ ID NO:850), which also corresponds to amino acids 1-203 of T59832_P9 (SEQ ID NO:145), and a second amino acid sequence being at least 70%, optionally at least 80%, preferably at least 85%, more preferably at least 90% and most preferably at least 95% homologous to a polypeptide having the sequence TABLE-US-00085 (SEQ ID NO: 1013) NPWKIRPSSLPLSASCTRARSRMSALPQ-PAPSGVFASSDGR corresponding to amino acids 204-244 of T59832_P9 (SEQ ID NO:145), wherein said first and second amino acid sequences are contiguous and in a sequential order.

According to preferred embodiments of the present invention, there is provided an isolated polypeptide encoding for a tail of T59832_P9 (SEQ ID NO:145), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQ-PAPSGVFASSDGR (SEQ ID NO:1013) in T59832_P9 (SEO ID NO:145).

According to preferred embodiments of the present invention, there is provided an isolated chimeric polypeptide encoding for T59832_P12 (SEQ ID NO:146), comprising a first amino acid sequence being at least 90% homologous to MTLSPLLLFLPPLLLLLDVPTMVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVE corresponding to amino acids 12-141 of GILT_HUMAN (SEQ ID NO:142), which also corresponds to amino acids 1-130 of T59832_P12 (SEQ ID NO:146), and a second amino acid sequence being at least 90% homologous to CLQLYAPGLSPDTIMECAMGDRG-MQLMHANAQRTDALQPPHEYVPWVTVNGKPLED QTQLLTLVCQLYQGKKPDVCPSSTSSLRSVCFK corresponding to amino acids 173-261 of GILT_HUMAN (SEQ ID NO:142), which also corresponds to amino acids 131-219 of T59832_P12 (SEQ ID NO:146), wherein said first and second amino acid sequences are contiguous and in a sequential order.

According to preferred embodiments of the present invention, there is provided an isolated chimeric polypeptide encoding for an edge portion of T59832_P12 (SEQ ID NO:146), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EC, having a structure as follows: a sequence starting from any of amino acid numbers 130-x to 130; and ending at any of amino acid numbers 131+((n−2)-x), in which x varies from 0 to n−2.

According to preferred embodiments of the present invention, there is provided an isolated chimeric polypeptide encoding for T59832_P12 (SEQ ID NO:146), comprising a first amino acid sequence being at least 70%, optionally at least 80%, preferably at least 85%, more preferably at least 90% and most preferably at least 95% homologous to a polypeptide having the sequence MTLSPLLLFLPPLLLLL-DVPTMVQASPLQALDFFGNGPPVNYKT-GNLYLRGPLKKSNA PLVNVTLYYEALCGGCRAF-LIRELFPTWLLV (SEQ ID NO:1012) corresponding to amino acids 1-90 of T59832_P12 (SEQ ID NO:146), second amino acid sequence being at least 90% homologous to MEILNVTLVPYGNAQEQNVSGRWEFKC-QHGEEECKFNKVE corresponding to amino acids 1-40 of BAC85622 (SEQ ID NO:849), which also corresponds to amino acids 91-130 of T59832_P12 (SEQ ID NO:146), third amino acid sequence being at least 90% homologous to CLQ-LYAPGLSPDTIMECAMGDRGMQLMHA-NAQRTDALQPPHEYVPWVTVNG corresponding to amino acids 72-122 of BAC85622 (SEQ ID NO:849), which also corresponds to amino acids 131-181 of T59832_P 12 (SEQ ID NO:146), and a fourth amino acid sequence being at least 70%, optionally at least 80%, preferably at least 85%, more preferably at least 90% and most preferably at least 95% homologous to a polypeptide having the sequence KPLEDQTQLLTLVCQLYQGKKPD-VCPSSTSSLRSVCFK (SEQ ID NO:1016) corresponding to amino acids 182-219 of T59832_P12 (SEQ ID NO:146), wherein said first, second, third and fourth amino acid sequences are contiguous and in a sequential order.

According to preferred embodiments of the present invention, there is provided an isolated polypeptide encoding for a head of T59832_P12 (SEQ ID NO:146), comprising a polypeptide being at least 70%, optionally at least about 80%, preferably at least about 85%, more preferably at least about 90% and most preferably at least about 95% homologous to the sequence TABLE-US-00086 MTLSPLLLFLPPLLLLL-DVPTMVQASPLQALDFFGNGPPVNYKT-GNLYLRGPLKKSNA (SEQ ID NO: 1012) PLVNVTLY-YEALCGGCRAFLIRELFPTWLLV of T59832_P12. (SEQ ID NO: 146)

According to preferred embodiments of the present invention, there is provided an isolated chimeric polypeptide encoding for an edge portion of T59832_P12 (SEQ ID NO:146), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EC, having a structure as follows: a sequence starting from any of amino acid numbers 130-x to 130; and ending at any of amino acid numbers 131+((n−2)-x), in which x varies from 0 to n−2.

According to preferred embodiments of the present invention, there is provided an isolated polypeptide encoding for a tail of T59832_P 12 (SEQ ID NO:146), comprising a polypeptide being at least 70%, optionally at least about 80%, preferably at least about 85%, more preferably at least about 90% and most preferably at least about 95% homologous to the sequence KPLEDQTQLLTLVCQLYQGKKPDVCPS STS SLRSVCFK (SEO ID NO:1016) in T59832_P12 (SEQ ID NO:146).

According to preferred embodiments of the present invention, there is provided an isolated chimeric polypeptide encoding for T59832_P12 (SEQ ID NO:146), comprising a first amino acid sequence being at least 90% homologous to MTLSPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVE corresponding to amino acids 1-130 of Q8WU77 (SEQ ID NO:850), which also corresponds to amino acids 1-130 of T59832_P12 (SEQ ID NO:146), and a second amino acid sequence being at least 90% homologous to CLQLYAPGLSPDTIMECAMGDRGMQLM-HANAQRTDALQPPHEYVPWVTVNGKPLED QTQLLTLVCQLYQGKKPDVCPSSTSSLRSVCFK corresponding to amino acids 162-250 of Q8WU77 (SEQ ID NO:850), which also corresponds to amino acids 131-219 of T59832_P12 (SEQ ID NO:146), wherein said first and second amino acid sequences are contiguous and in a sequential order.

According to preferred embodiments of the present invention, there is provided an isolated chimeric polypeptide encoding for an edge portion of T59832_P12 (SEQ ID NO:146), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EC, having a structure as follows: a sequence starting from any of amino acid numbers 130-x to 130; and ending at any of amino acid numbers 131+((n-2)-x), in which x varies from 0 to n-2.

According to preferred embodiments of the present invention, there is provided an isolated chimeric polypeptide encoding for T59832_P18 (SEQ ID NO:147), comprising a first amino acid sequence being at least 90% homologous to MTLSPLLLFLPPLLLLLDVPTAAVQAS-PLQALDFFGNGPPVNYK corresponding to amino acids 12-55 of GILT_HUMAN (SEQ ID NO:142), which also corresponds to amino acids 1-44 of T59832_P18 (SEQ ID NO:147), and a second amino acid sequence being at least 90% homologous to CLQLYAPGLSPDTIMECAMGDRG-MQLMHANAQRTDALQPPHEYVPWVTVNGKPLED QTQLLTLVCQLYQGKKPDVCPSSTSSLRSVCFK corresponding to amino acids 173-261 of GILT_HUMAN (SEQ ID NO:142), which also corresponds to amino acids 45-133 of T59832_P18 (SEQ ID NO:147), wherein said first and second amino acid sequences are contiguous and in a sequential order.

According to preferred embodiments of the present invention, there is provided an isolated chimeric polypeptide encoding for an edge portion of T59832_PI18 (SEQ ID NO:147), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KC, having a structure as follows: a sequence starting from any of amino acid numbers 44-x to 44; and ending at any of amino acid numbers 45+((n-2)-x), in which x varies from 0 to n-2.

According to preferred embodiments of the present invention, there is provided an isolated chimeric polypeptide encoding for T59832_P18 (SEQ ID NO:147), comprising a first amino acid sequence being at least 90% homologous to MTLSPLLLFLPPLLLLLDVPTAAVQAS-PLQALDFFGNGPPVNYK corresponding to amino acids 1-44 of Q8WU77 (SEQ ID NO:850), which also corresponds to amino acids 1-44 of T59832_P18 (SEQ ID NO:147), and a second amino acid sequence being at least 90% homologous to CLQLYAPGLSPDTIMECAMGDRGMQLM-HANAQRTDALQPPHEYVPWVTVNGKPLED QTQLLTLVCQLYQGKKPDVCPSSTSSLRSVCFK corresponding to amino acids 162-250 of Q8WU77 (SEQ ID NO:850), which also corresponds to amino acids 45-133 of T59832_P18 (SEQ ID NO:147), wherein said first and second amino acid sequences are contiguous and in a sequential order.

According to preferred embodiments of the present invention, there is provided an isolated chimeric polypeptide encoding for an edge portion of T59832_P18 (SEQ ID NO:147), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KC, having a structure as follows: a sequence starting from any of amino acid numbers 44-x to 44; and ending at any of amino acid numbers 45+((n-2)-x), in which x varies from 0 to n-2.

According to preferred embodiments of the present invention, there is provided an isolated chimeric polypeptide encoding for T59832_P18 (SEQ ID NO:147), comprising a first amino acid sequence being at least 90% homologous to MTLSPLLLFLPPLLLLLDVPTAAVQAS-PLQALDFFGNGPPVNYK corresponding to amino acids 1-44 of Q8NE14 (SEQ ID NO:851), which also corresponds to amino acids 1-44 of T59832_P18 (SEQ ID NO:147), and a second amino acid sequence being at least 90% homologous to CLQLYAPGLSPDTIMECAMGDRGMQLM-HANAQRTDALQPPHEYVPWVTVNGKPLED QTQLLTLVCQLYQGKKPDVCPSSTSSLRSVCFK corresponding to amino acids 162-250 of Q8NE14 (SEQ ID NO:851), which also corresponds to amino acids 45-133 of T59832_P18 (SEQ ID NO:147), wherein said first and second amino acid sequences are contiguous and in a sequential order.

According to preferred embodiments of the present invention, there is provided an isolated chimeric polypeptide encoding for an edge portion of T59832_P18 (SEQ ID NO:147), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KC, having a structure as follows: a sequence starting from any of amino acid numbers 44-x to 44; and ending at any of amino acid numbers 45+((n-2)-x), in which x varies from 0 to n-2.

According to preferred embodiments of the present invention, there is provided an isolated chimeric polypeptide encoding for HUMGRP5E-P4 (SEQ ID NO:1566), comprising a first amino acid sequence being at least 90% homologous to MRGSELPLVLLALVLCLAPRGRAV-PLPAGGGTVLTKMYPRGNHWAVGHLMGKKSTG ESSSVSERGSLKQQLREYIRWEEAARN-LLGLIEAKENRNHQPPQPKALGNQQPSWDSED SSN-FKDVGSKGK corresponding to amino acids 1-127 of GRP_HUMAN, which also corresponds to amino acids 1-127 of HUMGRP5E_P4 (SEQ ID NO:156), and a second amino acid sequence being at least 90% homologous to GSQREGRNPQLNQQ corresponding to amino acids 135-148 of GRP_HUMAN, which also corresponds to amino acids 128-141 of HUMGRP5E_P4 (SEQ ID NO:156), wherein said first and second amino acid sequences are contiguous and in a sequential order.

According to preferred embodiments of the present invention, there is provided an isolated chimeric polypeptide encoding for an edge portion of HUMGRP5E_P4 (SEQ ID NO:156), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KG, having a structure as follows: a sequence starting from any of amino acid numbers 127-x to 127; and ending at any of amino acid numbers 128+((n-2)-x), in which x varies from 0 to n-2.

According to preferred embodiments of the present invention, there is provided an isolated chimeric polypeptide encoding for HUMGRP5E_P5 (SEQ ID NO:157), comprising a first amino acid sequence being at least 90% homologous to MRGSELPLVLLALVLCLAPRGRAV-PLPAGGGTVLTKMYPRGNHWAVGHLMGKKSTG ESSSVSERGSLKQQLREYIRWEEAARN-LLGLIEAKENRNHQPPQPKALGNQQPSWDSED SSN-FKDVGSKGK corresponding to amino acids 1-127 of GRP_HUMAN, which also corresponds to amino acids 1-127 of HUMGRP5E_P5 (SEQ ID NO:157), and a second amino acid sequence being at least 70%, optionally at least 80%, preferably at least 85%, more preferably at least 90% and most preferably at least 95% homologous to a polypeptide having the sequence DSLLQVLNVKEGTPS (SEQ ID NO:1017) corresponding to amino acids 128-142 of HUMGRP5E_P5 (SEQ ID NO:157), wherein said first and second amino acid sequences are contiguous and in a sequential order.

According to preferred embodiments of the present invention, there is provided an isolated polypeptide encoding for a tail of HUMGRP5E_P5 (SEQ ID NO:157), comprising a polypeptide being at least 70%, optionally at least about 80%, preferably at least about 85%, more preferably at least about 90% and most preferably at least about 95% homologous to the sequence DSLLQVLNVKEGTPS (SEQ ID NO:1017) in HUMGRP5E_P5 (SEQ ID NO:157).

According to preferred embodiments of the present invention, there is provided an isolated chimeric polypeptide encoding for AA155578_PEA.sub.--1_P4 (SEQ ID NO:178), comprising a first amino acid sequence being at least 90% homologous to MRAPHLHLSMSGARALAKLL-PLLMAQLWAAEAALLPQNDTRLD-PEAYGAPCARGSQ PWQVSLFNGLSFHCAGV-LVDQSWVLTAAHCGNKPLWARVGDDHLLLLQGEQL RRTT RSVVHPKYHQGSGPILPRRTDEHDLM-LLKLARP corresponding to amino acids 1-146 of KLKA_HUMAN (SEQ ID NO:177), which also corresponds to amino acids 1-146 of AA155578_PEA.sub.--1_P4 (SEQ ID NO:178), and a second amino acid sequence being at least 90% homologous to YNKGLTCSSITILSPKECEVFYPGV-VTNNMICAGLDRGQDPCQSDSGGPLVCDETLQGIL SWGVYPCGSAQHPAVYTQICKYMSWINKVIRSN corresponding to amino acids 184-276 of KLKA_HUMAN (SEQ ID NO:177), which also corresponds to amino acids 147-239 of AA155578_PEA.sub.--1_P4 (SEQ ID NO:178), wherein said first and second amino acid sequences are contiguous and in a sequential order.

According to preferred embodiments of the present invention, there is provided an isolated chimeric polypeptide encoding for an edge portion of AA155578_PEA.sub.--1_P4 (SEQ ID NO:178), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PY, having a structure as follows: a sequence starting from any of amino acid numbers 146-x to 146; and ending at any of amino acid numbers 147+((n−2)-x), in which x varies from 0 to n−2.

According to preferred embodiments of the present invention, there is provided an isolated chimeric polypeptide encoding for AA155578_PEA.sub.--1_P6 (SEQ ID NO:179), comprising a first amino acid sequence being at least 90% homologous to MRAPHLHLSAASGARALAK-LLPLLMAQLW corresponding to amino acids 1-29 of KLKA_HUMAN (SEQ ID NO:177), which also corresponds to amino acids 1-29 of AA155578_PEA.sub.--1 P6 (SEQ ID NO:179), and a second amino acid sequence being at least 90% homologous to VKYNKGLTCSSITILSPKECEV-FYPGVVTNNMICAGLDRGQDPCQSDSGG-PLVCDETLQ GILSWGVYPCGSAQHPAVYTQICKYM-SWINKVIRSN corresponding to amino acids 182-276 of KLKA_HUMAN (SEQ ID NO:177), which also corresponds to amino acids 30-124 of AA155578_PEA.sub.--1_P6 (SEQ ID NO:179), wherein said first and second amino acid sequences are contiguous and in a sequential order.

According to preferred embodiments of the present invention, there is provided an isolated chimeric polypeptide encoding for an edge portion of AA155578_PEA.sub.--1_P6 (SEQ ID NO: 179), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WV, having a structure as follows: a sequence starting from any of amino acid numbers 29-x to 29; and ending at any of amino acid numbers 30+((n−2)-x), in which x varies from 0 to n−2.

According to preferred embodiments of the present invention, there is provided an isolated chimeric polypeptide encoding for AA155578_PEA.sub.--1_P8 (SEQ ID NO:180), comprising a first amino acid sequence being at least 90% homologous to MRAPHLHLSAASGARALAK-LLPLLMAQLW corresponding to amino acids 1-29 of KLKA_HUMAN (SEQ ID NO:177), which also corresponds to amino acids 1-29 of AA155578_PEA.sub.--1_P8 (SEQ ID NO:180), and a second amino acid sequence being at least 70%, optionally at least 80%, preferably at least 85%, more preferably at least 90% and most preferably at least 95% homologous to a polypeptide having the sequence GHCGLE (SEQ ID NO:1018) corresponding to amino acids 30-35 of AA155578_PEA.sub.--1_P8 (SEQ ID NO:180), wherein said first and second amino acid sequences are contiguous and in a sequential order.

According to preferred embodiments of the present invention, there is provided an isolated polypeptide encoding for a tail of AA155578-PEA.sub.--1_P8 (SEQ ID NO:180), comprising a polypeptide being at least 70%, optionally at least about 80%, preferably at least about 85%, more preferably at least about 90% and most preferably at least about 95% homologous to the sequence GHCGLE (SEO ID NO:1018) in AA155578_PEA.sub.--1_P8 (SEQ ID NO:180).

According to preferred embodiments of the present invention, there is provided an isolated chimeric polypeptide encoding for AA155578_PEA.sub.--1_P9 (SEQ ID NO:181), comprising a first amino acid sequence being at least 90% homologous to MRAPHLHLSAASGARALAK-LLPLLMAQLWAAEAALLPQNDTRLD-PEAYGAPCARGSQ PWQVSLFNGLSFHCAGV-LVDQSWVLTAAHCGNK corresponding to amino acids 1-90 of KLKA_HUMAN (SEQ ID NO:177), which also corresponds to amino acids 1-90 of AA155578_PEA.sub.--1.sub.--P9 (SEQ ID NO:181).

According to preferred embodiments of the present invention, there is provided an isolated chimeric polypeptide encoding for HSENA78_P2 (SEQ ID NO:919), comprising a first amino acid sequence being at least 90% homologous to MSLLSSRAARVPGPSSSLCALLV-LLLLLTQPGPIASAGPAAAVLRELRCVCLQTTQGVHP KMISNLQVFAIGPQCSKVEVV corresponding to amino acids 1-81 of SZ05_HUMAN (SEQ ID NO:190), which also corresponds to amino acids 1-81 of HSENA78_P2 (SEQ ID NO:191) According to preferred embodiments of the present invention, there is provided an isolated chimeric polypeptide encoding for T94936_PEA.sub.--1_P2 (SEQ ID NO:206), comprising a first amino acid sequence being at least 90% homologous to MMLHSALGLCLLLVTVSSNLAI-AIKKEKRPPQTLSRGWGDDITWVQTYEEGLFYAQKS KKPLMVIHHLEDCQYSQALKKV-FAQNEEIQEMAQNKFIMLNLMHETTDKNLSPDGQY VPRIMFVDPSLTVRADIAGRYSNRLYTYEPRDLPL corresponding to amino acids 1-150 of Q8TD06 (SEQ ID NO:858), which also corresponds to amino acids 1-150 of T94936_PEA.sub.--1_P2 (SEQ ID NO:206).

According to preferred embodiments of the present invention, there is provided an isolated chimeric polypeptide encoding for T94936_PEA.sub.--1_P3 (SEQ ID NO:207), comprising a first amino acid sequence being at least 90% homologous to MMLHSALGLCLLLVTVSSNLAI-AIKKEKRPPQTLSRGWGDDITWVQTYEEGLFYAQKS KKPLMVIHHLEDCQYSQALKKV-FAQNEEIQEMAQNKFIMLNLMHETTDKNLSPDGQY VPRIMFV corresponding to amino acids 1-122 of Q8TD06 (SEQ ID NO:858), which also corresponds to amino acids 1-122 of T94936_PEA.sub.--1_P3 (SEQ ID NO:207), and a second amino acid sequence being at least 70%, optionally at least 80%, preferably at least 85%, more preferably at least 90% and most preferably at least 95% homologous to a polypeptide having the sequence GMYVISFHQIYKISRN-QHSCFYF (SEO ID NO:1019) corresponding to amino acids 123-145 of T94936_PEA.sub.--1_P3 (SEQ ID NO:207), wherein said first and second amino acid sequences are contiguous and in a sequential order.

According to preferred embodiments of the present invention, there is provided an isolated polypeptide encoding for a tail of T94936_PEA.sub.--1_P3 (SEQ ID NO:207), comprising a polypeptide being at least 70%, optionally at least about 80%, preferably at least about 85%, more preferably at least about 90% and most preferably at least about 95% homologous to the sequence GMYVISFHQIYKISRNQHSCFYF (SEQ ID NO:1019) in T94936_PEA.sub.--1_P3 (SEQ ID NO:207).

According to preferred embodiments of the present invention, there is provided an isolated chimeric polypeptide encoding for Z41644_PEA.sub.--1_P10 (SEQ ID NO:231), comprising a first amino acid sequence being at least 90% homologous to MRLLAAALLLLLLALYTARVDG-SKCKCSRKGPKIRYSDVKKLEMKPKYPHCEEKMVII TTKSVSRYRGQEHCLHPKLQSTKRFIK-WYNAWNEKRR corresponding to amino acids 1-95 of SZ14_HUMAN (SEQ ID NO:230), which also corresponds to amino acids 1-95 of Z41644_PEA.sub.--1_P10 (SEQ ID NO:231), and a second amino acid sequence being at least 70%, optionally at least 80%, preferably at least 85%, more preferably at least 90% and most preferably at least 95% homologous to a polypeptide having the sequence YAPPLLT-FLPTRPSCGSQDGKGPPHQVI (SEQ ID NO:1020) corresponding to amino acids 96-123 of Z41644_PEA.sub.--1_P10 (SEQ ID NO:231), wherein said first and second amino acid sequences are contiguous and in a sequential order.

According to preferred embodiments of the present invention, there is provided an isolated polypeptide encoding for a tail of Z41644_PEA.sub.--1_P10 (SEQ ID NO:231), comprising a polypeptide being at least 70%, optionally at least about 80%, preferably at least about 85%, more preferably at least about 90% and most preferably at least about 95% homologous to the sequence YAPPLLTFLPTRPSCG-SQDGKGPPHQVI (SEQ ID NO:1020) in Z41644_PEA.sub.--1-P10 (SEQ ID NO:231).

According to preferred embodiments of the present invention, there is provided an isolated chimeric polypeptide encoding for Z41644_PEA.sub.--1_P10 (SEQ ID NO:231), comprising a first amino acid sequence being at least 90% homologous to MRLLAAALLLLLLALYTARVDG-SKCKCSRKGPKIRYSDVKKLEMKPKYPHCEEKMVII TTKSVSRYRGQEHCLHPKLQSTKRFIK-WYNAWNEKRR corresponding to amino acids 13-107 of Q9NS21 (SEQ ID NO:862), which also corresponds to amino acids 1-95 of Z41644_PEA.sub.--1_P10 (SEQ ID NO:231), and a second amino acid sequence being at least 70%, optionally at least 80%, preferably at least 85%, more preferably at least 90% and most preferably at least 95% homologous to a polypeptide having the sequence YAPPLLTFLPTRPSCG-SQDGKGPPHQVI (SEQ ID NO:1020) corresponding to amino acids 96-123 of Z41644_PEA.sub.--1_P10 (SEQ ID NO:231), wherein said first and second amino acid sequences are contiguous and in a sequential order.

According to preferred embodiments of the present invention, there is provided an isolated polypeptide encoding for a tail of Z41644_PEA.sub.--1_P10 (SEQ ID NO:231), comprising a polypeptide being at least 70%, optionally at least about 80%, preferably at least about 85%, more preferably at least about 90% and most preferably at least about 95% homologous to the sequence YAPPLLTFLPTRPSCG-SQDGKGPPHQVI (SEQ ID NO:1020) in Z41644_PEA.sub.--1P10 (SEQ ID NO:231).

According to preferred embodiments of the present invention, there is provided an isolated chimeric polypeptide encoding for Z41644_PEA.sub.--1_P10 (SEQ ID NO:231), comprising a first amino acid sequence being at least 90% homologous to MRLLAAALLLLLLALYTARVDG-SKCKCSRKGPKIRYSDVKKLEMKPKYPHCEEKMVII TTKSVSRYRGQEHCLHPKLQSTKRFIK-WYNAWNEKRR corresponding to amino acids 13-107 of AAQ89265, which also corresponds to amino acids 1-95 of Z41644_PEA.sub.--1_P10 (SEQ ID NO:231), and a second amino acid sequence being at least 70%, optionally at least 80%, preferably at least 85%, more preferably at least 90% and most preferably at least 95% homologous to a polypeptide having the sequence YAPPLLTFLPTRPSCGSQDGKG-PPHQVI (SEQ ID NO:1020) corresponding to amino acids 96-123 of Z41644_PEA.sub.--1_P10 (SEQ ID NO:231), wherein said first and second amino acid sequences are contiguous and in a sequential order.

According to preferred embodiments of the present invention, there is provided an isolated polypeptide encoding for a tail of Z41644_PEA.sub.--1_P10 (SEQ ID NO:231), comprising a polypeptide being at least 70%, optionally at least about 80%, preferably at least about 85%, more preferably at least about 90% and most preferably at least about 95% homologous to the sequence YAPPLLTFLPTRPSCG-SQDGKGPPHQVI (SEQ ID NO:1020) in Z41644_PEA.sub.--1.sub.--P10(SEQ ID NO:231).

According to preferred embodiments of the present invention, there is provided an isolated oligonucleotide, comprising an amplicon selected from the group consisting of SEQ ID NOs: 891 or 894.

According to preferred embodiments of the present invention, there is provided a primer pair, comprising a pair of isolated oligonucleotides capable of amplifying the above. Optionally, the pair of isolated oligonucleotides is selected from the group consisting of: SEQ NOs 889 and 890; or 892 and 893.

According to preferred embodiments of the present invention, there is provided an antibody capable of specifically binding to an epitope of an amino acid sequence as described herein. Optionally, the epitope may comprise a tail, head, or edge portion as described herein.

According to preferred embodiments of the present invention, the antibody is capable of differentiating between a splice variant having said epitope and a corresponding known protein.

According to preferred embodiments of the present invention, there is provided an kit for detecting breast cancer, comprising a kit detecting overexpression of a splice variant as described herein. Optionally, the kit comprises a NAT-based technology. Preferably, the kit further comprises at least one primer pair capable of selectively hybridizing to a nucleic acid sequence as described herein. Optionally, the kit further comprises at least one oligonucleotide capable of selectively hybridizing to a nucleic acid sequence as described herein.

Optionally, the kit comprises an antibody as described herein. Preferably, the kit further comprises at least one reagent for performing an ELISA or a Western blot.

According to preferred embodiments of the present invention, there is provided a method for detecting breast cancer, comprising detecting overexpression of a splice variant as described herein.

Optionally detecting overexpression is performed with a NAT-based technology. Preferably, detecting overexpression is performed with an immunoassay. More preferably, the immunoassay comprises an antibody as described herein.

According to preferred embodiments of the present invention, there is provided a biomarker capable of detecting breast cancer, comprising any of the above nucleic acid sequences or a fragment thereof, or any of the above amino acid sequences or a fragment thereof.

According to preferred embodiments of the present invention, preferably any of the above nucleic acid and/or amino acid sequences further comprises any sequence having at least about 70%, preferably at least about 80%, more preferably at least about 90%, most preferably at least about 95% homology thereto.

Unless otherwise noted, all experimental data relates to variants of the present invention, named according to the segment being tested (as expression was tested through RT-PCR as described).

All nucleic acid sequences and/or amino acid sequences shown herein as embodiments of the present invention relate to their isolated form, as isolated polynucleotides (including for all transcripts), oligonucleotides (including for all segments, amplicons and primers), peptides (including for all tails, bridges, insertions or heads, optionally including other antibody epitopes as described herein) and/or polypeptides (including for all proteins). It should be noted that oligonucleotide and polynucleotide, or peptide and polypeptide, may optionally be used interchangeably.

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). All of these are hereby incorporated by reference as if fully set forth herein. As used herein, the following terms have the meanings ascribed to them unless specified otherwise.

DESCRIPTION OF PREFERRED EMBODIMENTS

Figure 1:
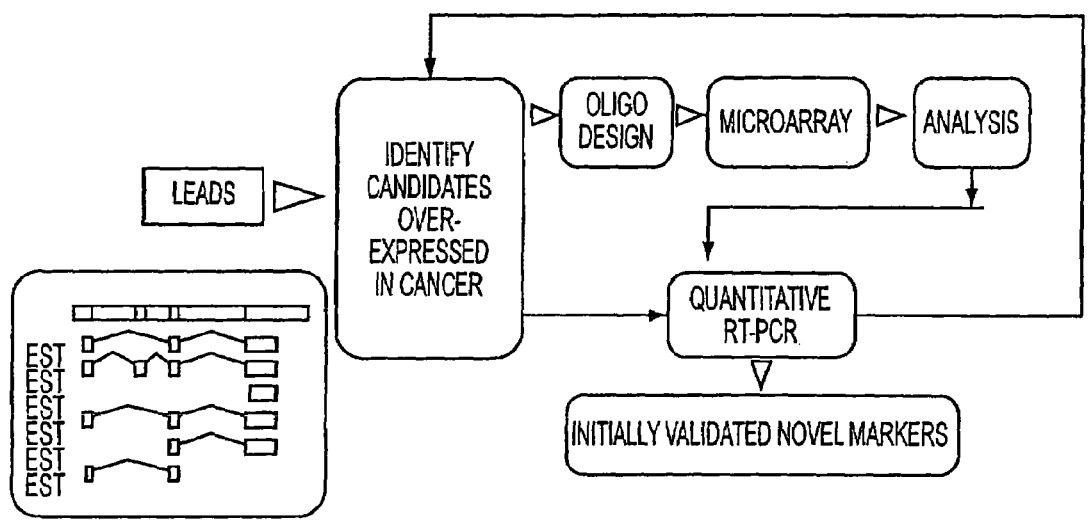
FIG. 1 is schematic summary of cancer biomarkers selection engine and the wet validation stages.

The present invention is of novel markers for breast cancer that are both sensitive and accurate. Furthermore, at least certain of these markers are able to distinguish between different stages of breast cancer, such as 1. Ductal carcinoma (in-situ, invasive) 2. Lobular carcinoma (is-situ, invasive) 3. inflammatory breast cancer 4. Mucinous carcinoma 5. Tubular carcinoma 6. Paget's disease of nipple, alone or in combination; or one of the indicative conditions described above.

The markers of the present invention, alone or in combination, can be used for prognosis, prediction, screening, early diagnosis, staging, therapy selection and treatment monitoring of breast cancer. For example, optionally and preferably, these markers may be used for staging breast cancer and/or monitoring the progression of the disease. Furthermore, the markers of the present invention, alone or in combination, can be used for detection of the source of metastasis found in anatomical places other then breast. Also, one or more of the markers may optionally be used in combination with one or more other breast cancer markers (other than those described herein).

Biomolecular sequences (amino acid and/or nucleic acid sequences) uncovered using the methodology of the present invention and described herein can be efficiently utilized as tissue or pathological markers and/or as drugs or drug targets for treating or preventing a disease.

These markers are specifically released to the bloodstream under conditions of breast cancer (or one of the above indicative conditions), and/or are otherwise expressed at a much higher level and/or specifically expressed in breast cancer tissue or cells, and/or tissue or cells under one of the above indicative conditions. The measurement of these markers, alone or in combination, in patient samples provides information that the diagnostician can correlate with a probable diagnosis of breast cancer and/or a condition that it is indicative of a higher risk for breast cancer.

The present invention therefore also relates to diagnostic assays for breast cancer and/or an indicative condition, and methods of use of such markers for detection of breast cancer and/or an indicative condition, optionally and preferably in a sample taken from a subject (patient), which is more preferably some type of blood sample.

According to a preferred embodiment of the present invention, use of the marker optionally and preferably permits a non-cancerous breast disease state to be distinguished from breast cancer and/or an indicative condition. A non limiting example of a non-cancerous breast disease state includes breast fibrosis and/or cysts. According to another preferred embodiment of the present invention, use of the marker optionally and preferably permits an indicative condition to be distinguished from breast cancer.

In another embodiment, the present invention relates to bridges, tails, heads and/or insertions, and/or analogs, homologs and derivatives of such peptides. Such bridges, tails, heads and/or insertions are described in greater detail below with regard to the Examples.

As used herein a "tail" refers to a peptide sequence at the end of an amino acid sequence that is unique to a splice variant according to the present invention. Therefore, a splice variant having such a tail may optionally be considered as a chimera, in that at least a first portion of the splice variant is typically highly homologous (often 100% identical) to a portion of the corresponding known protein, while at least a second portion of the variant comprises the tail.

As used herein a "head" refers to a peptide sequence at the beginning of an amino acid sequence that is unique to a splice variant according to the present invention. Therefore, a splice variant having such a head may optionally be considered as a chimera, in that at least a first portion of the splice variant comprises the head, while at least a second portion is typically highly homologous (often 100% identical) to a portion of the corresponding known protein.

As used herein "an edge portion" refers to a connection between two portions of a splice variant according to the present invention that were not joined in the wild type or known protein. An edge may optionally arise due to a join between the above "known protein" portion of a variant and the tail, for example, and/or may occur if an internal portion of the wild type sequence is no longer present, such that two portions of the sequence are now contiguous in the splice variant that were not contiguous in the known protein. A "bridge" may optionally be an edge portion as described above, but may also include a join between a head and a "known protein" portion of a variant, or a join between a tail and a "known protein" portion of a variant, or a join between an insertion and a "known protein" portion of a variant.

Optionally and preferably, a bridge between a tail or a head or a unique insertion, and a "known protein" portion of a variant, comprises at least about 10 amino acids, more preferably at least about 20 amino acids, most preferably at least about 30 amino acids, and even more preferably at least about 40 amino acids, in which at least one amino acid is from the tail/head/insertion and at least one amino acid is from the "known protein" portion of a variant. Also optionally, the bridge may comprise any number of amino acids from about 10 to about 40 amino acids (for example, 10, 11, 12, 13 . . . 37, 38, 39, 40 amino acids in length, or any number in between).

It should be noted that a bridge cannot be extended beyond the length of the sequence in either direction, and it should be assumed that every bridge description is to be read in such manner that the bridge length does not extend beyond the sequence itself.

Furthermore, bridges are described with regard to a sliding window in certain contexts below. For example, certain descriptions of the bridges feature the following format: a bridge between two edges (in which a portion of the known protein is not present in the variant) may optionally be described as follows: a bridge portion of CONTIG-NAME_P1 (representing the name of the protein), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise XX (2 amino acids in the center of the bridge, one from each end of the edge), having a structure as follows (numbering according to the sequence of CONTIG-NAME_P1): a sequence starting from any of amino acid numbers 49-x to 49 (for example); and ending at any of amino acid numbers 50+((n−2)-x) (for example), in which x varies from 0 to n−2. In this example, it should also be read as including bridges in which n is any number of amino acids between 10-50 amino acids in length. Furthermore, the bridge polypeptide cannot extend beyond the sequence, so it should be read such that 49-x (for example) is not less than 1, nor 50+((n−2)-x) (for example) greater than the total sequence length.

In another embodiment, this invention provides antibodies specifically recognizing the splice variants and polypeptide fragments thereof of this invention. Preferably such antibodies differentially recognize splice variants of the present invention but do not recognize a corresponding known protein (such known proteins are discussed with regard to their splice variants in the Examples below).

In another embodiment, this invention provides an isolated nucleic acid molecule encoding for a splice variant according to the present invention, having a nucleotide sequence as set forth in any one of the sequences listed herein, or a sequence complementary thereto. In another embodiment, this invention provides an isolated nucleic acid molecule, having a nucleotide sequence as set forth in any one of the sequences listed herein, or a sequence complementary thereto. In another embodiment, this invention provides an oligonucleotide of at least about 12 nucleotides, specifically hybridizable with the nucleic acid molecules of this invention. In another embodiment, this invention provides vectors, cells, liposomes and compositions comprising the isolated nucleic acids of this invention.

In another embodiment, this invention provides a method for detecting a splice variant according to the present invention in a biological sample, comprising: contacting a biological sample with an antibody specifically recognizing a splice variant according to the present invention under conditions whereby the antibody specifically interacts with the splice variant in the biological sample but do not recognize known corresponding proteins (wherein the known protein is discussed with regard to its splice variant(s) in the Examples below), and detecting said interaction; wherein the presence of an interaction correlates with the presence of a splice variant in the biological sample.

In another embodiment, this invention provides a method for detecting a splice variant nucleic acid sequences in a biological sample, comprising: hybridizing the isolated nucleic acid molecules or oligonucleotide fragments of at least about a minimum length to a nucleic acid material of a biological sample and detecting a hybridization complex; wherein the presence of a hybridization complex correlates with the presence of a splice variant nucleic acid sequence in the biological sample.

According to the present invention, the splice variants described herein are non-limiting examples of markers for diagnosing breast cancer and/or an indicative condition. Each splice variant marker of the present invention can be used alone or in combination, for various uses, including but not limited to, prognosis, prediction, screening, early diagnosis, determination of progression, therapy selection and treatment monitoring of breast cancer and/or an indicative condition, including a transition from an indicative condition to breast cancer.

According to optional but preferred embodiments of the present invention, any marker according to the present invention may optionally be used alone or combination. Such a combination may optionally comprise a plurality of markers described herein, optionally including any subcombination of markers, and/or a combination featuring at least one other marker, for example a known marker. Furthermore, such a combination may optionally and preferably be used as described above with regard to determining a ratio between a quantitative or semi-quantitative measurement of any marker described herein to any other marker described herein, and/or any other known marker, and/or any other marker. With regard to such a ratio between any marker described herein (or a combination thereof and a known marker, more preferably the known marker comprises the "known protein" as described in greater detail below with regard to each cluster or gene.

According to other preferred embodiments of the present invention, a splice variant protein or a fragment thereof, or a splice variant nucleic acid sequence or a fragment thereof, may be featured as a biomarker for detecting breast cancer and/or an indicative condition, such that a biomarker may optionally comprise any of the above.

According to still other preferred embodiments, the present invention optionally and preferably encompasses any amino acid sequence or fragment thereof encoded by a nucleic acid sequence corresponding to a splice variant protein as described herein. Any oligopeptide or peptide relating to such an amino acid sequence or fragment thereof may optionally also (additionally or alternatively) be used as a biomarker, including but not limited to the unique amino acid sequences of these proteins that are depicted as tails, heads, insertions, edges or bridges. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to a splice variant of the present invention as described above, optionally for any application.

Non-limiting examples of methods or assays are described below.

The present invention also relates to kits based upon such diagnostic methods or assays.

Nucleic Acid Sequences and Oligonucleotides

Various embodiments of the present invention encompass nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or artificially induced, either randomly or in a targeted fashion.

The present invention encompasses nucleic acid sequences described herein; fragments thereof, sequences hybridizable therewith, sequences homologous thereto [e.g., at least 50%, at least 55%, at least 60%, at least 65%, at least 70%, at least 75%, at least 80%, at least 85%, least 95% or more say 100% identical to the nucleic acid sequences set forth below], sequences encoding similar polypeptides with different codon usage, altered sequences characterized by mutations, such as deletion, insertion or substitution of one or more nucleotides, either naturally occurring or man induced, either randomly or in a targeted fashion. The present invention also encompasses homologous nucleic acid sequences (i.e., which form a part of a polynucleotide sequence of the present invention) which include sequence regions unique to the polynucleotides of the present invention.

In cases where the polynucleotide sequences of the present invention encode previously unidentified polypeptides, the present invention also encompasses novel polypeptides or portions thereof, which are encoded by the isolated polynucleotide and respective nucleic acid fragments thereof described hereinabove.

A "nucleic acid fragment" or an "oligonucleotide" or a "polynucleotide" are used herein interchangeably to refer to a polymer of nucleic acids. A polynucleotide sequence of the present invention refers to a single or double stranded nucleic acid sequences which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is composed of genomic and cDNA sequences. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Preferred embodiments of the present invention encompass oligonucleotide probes.

An example of an oligonucleotide probe which can be utilized by the present invention is a single stranded polynucleotide which includes a sequence complementary to the unique sequence region of any variant according to the present invention, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Alternatively, an oligonucleotide probe of the present invention can be designed to hybridize with a nucleic acid sequence encompassed by any of the above nucleic acid sequences, particularly the portions specified above, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Oligonucleotides designed according to the teachings of the present invention can be generated according to any oligonucleotide synthesis method known in the art such as enzymatic synthesis or solid phase synthesis. Equipment and reagents for executing solid-phase synthesis are commercially available from, for example, Applied Biosystems. Any other means for such synthesis may also be employed; the actual synthesis of the oligonucleotides is well within the capabilities of one skilled in the art and can be accomplished via established methodologies as detailed in, for example, "Molecular Cloning: A laboratory Manual" Sambrook et al., (1989); "Current Protocols in Molecular Biology" Volumes 1-111 Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988) and "Oligonucleotide Synthesis" Gait, M. J., ed. (1984) utilizing solid phase chemistry, e.g. cyanoethyl phosphoramidite followed by deprotection, desalting and purification by for example, an automated trityl-on method or HPLC.

Oligonucleotides used according to this aspect of the present invention are those having a length selected from a range of about 10 to about 200 bases preferably about 15 to about 150 bases, more preferably about 20 to about 100 bases, most preferably about 20 to about 50 bases. Preferably, the oligonucleotide of the present invention features at least 17, at least 18, at least 19, at least 20, at least 22, at least 25, at least 30 or at least 40, bases specifically hybridizable with the biomarkers of the present invention.

The oligonucleotides of the present invention may comprise heterocylic nucleosides consisting of purines and the pyrimidines bases, bonded in a 3' to 5' phosphodiester linkage.

Preferably used oligonucleotides are those modified at one or more of the backbone, internucleoside linkages or bases, as is broadly described hereinunder.

Specific examples of preferred oligonucleotides useful according to this aspect of the present invention include oligonucleotides containing modified backbones or non-natural internucleoside linkages. Oligonucleotides having modified backbones include those that retain a phosphorus atom in the backbone, as disclosed in U.S. Pat. Nos: 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466, 677; 5,476,925; 5,519,126; 5,536,821; 5,541,306; 5,550,111; 5,563,253; 5,571,799; 5,587,361; and 5,625,050.

Preferred modified oligonucleotide backbones include, for example, phosphorothioates, chiral phosphorothioates, phosphorodithioates, phosphotriesters, aminoalkyl phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid for used.

Alternatively, modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH.sub.2 component parts, as disclosed in U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677;

5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439.

Other oligonucleotides which can be used according to the present invention, are those modified in both sugar and the internucleoside linkage, i.e., the backbone, of the nucleotide units are replaced with novel groups. The base units are maintained for complementation with the appropriate polynucleotide target. An example for such an oligonucleotide mimetic, includes peptide nucleic acid (PNA). U.S. patents that teach the preparation of PNA compounds include, but are not limited to, U.S. Pat. Nos. 5,539,082; 5,714,331; and 5,719,262, each of which is herein incorporated by reference. Other backbone modifications, which can be used in the present invention are disclosed in U.S. Pat. No: 6,303,374.

Oligonucleotides of the present invention may also include base modifications or substitutions. As used herein, "unmodified" or "natural" bases include the purine bases adenine (A) and guanine (G), and the pyrimidine bases thymine (T), cytosine (C) and uracil (U). Modified bases include but are not limited to other synthetic and natural bases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further bases particularly useful for increasing the binding affinity of the oligomeric compounds of the invention include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2. degree. C. and are presently preferred base substitutions, even more particularly when combined with 2'-O-methoxyethyl sugar modifications.

Another modification of the oligonucleotides of the invention involves chemically linking to the oligonucleotide one or more moieties or conjugates, which enhance the activity, cellular distribution or cellular uptake of the oligonucleotide. Such moieties include but are not limited to lipid moieties such as a cholesterol moiety, cholic acid, a thioether, e.g., hexyl-S-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxycholesterol moiety, as disclosed in U.S. Pat. No: 6,303,374.

It is not necessary for all positions in a given oligonucleotide molecule to be uniformly modified, and in fact more than one of the aforementioned modifications may be incorporated in a single compound or even at a single nucleoside within an oligonucleotide.

It will be appreciated that oligonucleotides of the present invention may include further modifications for more efficient use as diagnostic agents and/or to increase bioavailability, therapeutic efficacy and reduce cytotoxicity.

To enable cellular expression of the polynucleotides of the present invention, a nucleic acid construct according to the present invention may be used, which includes at least a coding region of one of the above nucleic acid sequences, and further includes at least one cis acting regulatory element. As used herein, the phrase "cis acting regulatory element" refers to a polynucleotide sequence, preferably a promoter, which binds a trans acting regulator and regulates the transcription of a coding sequence located downstream thereto.

Any suitable promoter sequence can be used by the nucleic acid construct of the present invention.

Preferably, the promoter utilized by the nucleic acid construct of the present invention is active in the specific cell population transformed. Examples of cell type-specific and/or tissue-specific promoters include promoters such as albumin that is liver specific, lymphoid specific promoters [Calame et al., (1988) Adv. Immunol. 43:235-275]; in particular promoters of T-cell receptors [Winoto et al., (1989) EMBO J. 8:729-733] and immunoglobulins; [Banerji et al. (1983) Cell 33729-740], neuron-specific promoters such as the neurofilament promoter [Byrne et al. (1989) Proc. Natl. Acad. Sci. USA 86:5473-5477], pancreas-specific promoters [Edlunch et al. (1985) Science 230:912-916] or mammary gland-specific promoters such as the milk whey promoter (U.S. Pat. No. 4,873,316 and European Application Publication No. 264, 166). The nucleic acid construct of the present invention can further include an enhancer, which can be adjacent or distant to the promoter sequence and can function in up regulating the transcription therefrom.

The nucleic acid construct of the present invention preferably further includes an appropriate selectable marker and/or an origin of replication. Preferably, the nucleic acid construct utilized is a shuttle vector, which can propagate both in $E.$ $coli$ (wherein the construct comprises an appropriate selectable marker and origin of replication) and be compatible for propagation in cells, or integration in a gene and a tissue of choice. The construct according to the present invention can be, for example, a plasmid, a bacmid, a phagemid, a cosmid, a phage, a virus or an artificial chromosome.

Examples of suitable constructs include, but are not limited to, pcDNA3, pcDNA3.1 (+/), pGL3, PzeoSV2 (+/−), pDisplay, pEF/myc/cyto, pCMV/myc/cyto each of which is commercially available from Invitrogen Co. (invitrogen.com). Examples of retroviral vector and packaging systems are those sold by Clontech, San Diego, Calif., including Retro-X vectors pLNCX and pLXSN, which permit cloning into multiple cloning sites and the transgene is transcribed from CMV promoter. Vectors derived from Mo-MuLV are also included such as pBabe, where the transgene will be transcribed from the 5'LTR promoter.

Currently preferred in vivo nucleic acid transfer techniques include transfection with viral or non-viral constructs, such as adenovirus, lentivirus, Herpes simplex I virus, or adeno-associated virus (AAV) and lipid-based systems. Useful lipids for lipid-mediated transfer of the gene are, for example, DOTMA, DOPE, and DC-Chol [Tonkinson et al., Cancer Investigation, 14(1): 54-65 (1996)]. The most preferred constructs for use in gene therapy are viruses, most preferably adenoviruses, AAV, lentiviruses, or retroviruses. A viral construct such as a retroviral construct includes at least one transcriptional promoter/enhancer or locus-defining element(s), or other elements that control gene expression by other means such as alternate splicing, nuclear RNA export, or post-translational modification of messenger. Such vector constructs also include a packaging signal, long terminal repeats (LTRs) or portions thereof, and positive and negative strand primer binding sites appropriate to the virus used, unless it is already present in the viral construct. In addition, such a construct typically includes a signal sequence for secretion of the peptide from a host cell in which it is placed. Preferably the signal sequence for this purpose is a mammalian signal sequence or the signal sequence of the polypeptide variants of the present invention. Optionally, the construct may also include a signal that directs polyadenylation, as well as one or more restriction sites and a translation termination sequence. By way of example, such constructs will typically include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

Hybridization Assays

Detection of a nucleic acid of interest in a biological sample may optionally be effected by hybridization-based assays using an oligonucleotide probe (non-limiting examples of probes according to the present invention were previously described).

Traditional hybridization assays include PCR, RT-PCR, Real-time PCR, RNase protection, in-situ hybridization, primer extension, Southern blots (DNA detection), dot or slot blots (DNA, RNA), and Northern blots (RNA detection) (NAT type assays are described in greater detail below). More recently, PNAs have been described (Nielsen et al. 1999, Current Opin. Biotechnol. 10:71-75). Other detection methods include kits containing probes on a dipstick setup and the like.

Hybridization based assays which allow the detection of a variant of interest (i.e., DNA or RNA) in a biological sample rely on the use of oligonucleotides which can be 10, 15, 20, or 30 to 100 nucleotides long preferably from 10 to 50, more preferably from 40 to 50 nucleotides long.

Thus, the isolated polynucleotides (oligonucleotides) of the present invention are preferably hybridizable with any of the herein described nucleic acid sequences under moderate to stringent hybridization conditions.

Moderate to stringent hybridization conditions are characterized by a hybridization solution such as containing 10% dextrane sulfate, 1 M NaCl, 1% SDS and $5 \times 10^6$ cpm $^{32}P$ labeled probe, at 65° C., with a final wash solution of $0.2 \times SSC$ and 0.1% SDS and final wash at 65° C. and whereas moderate hybridization is effected using a hybridization solution containing 10% dextrane sulfate, 1 M NaCl, 1% SDS and $5 \times 10^6$ cpm $^{32}p$ labeled probe, at 65° C., with a final wash solution of $1 \times SSC$ and 0.1% SDS and final wash at 50° C.

More generally, hybridization of short nucleic acids (below 200 bp in length, e.g. 17-40 bp in length) can be effected using the following exemplary hybridization protocols which can be modified according to the desired stringency; (i) hybridization solution of $6 \times SSC$ and 1% SDS or 3 M TMACl, 0.01 M sodium phosphate (pH 6.8), 1 mM EDTA (pH 7.6), 0.5% SDS, 100 $\mu g/ml$ denatured salmon sperm DNA and 0.1% nonfat dried milk, hybridization temperature of 1-1.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$; (ii) hybridization solution of $6 \times SSC$ and 0.1% SDS or 3 M TMACl, 0.01 M sodium phosphate (pH 6.8), 1 mM EDTA (pH 7.6), 0.5% SDS, 100 $\mu g/ml$ denatured salmon sperm DNA and 0.1% nonfat dried milk, hybridization temperature of 2-2.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$, final wash solution of $6 \times SSC$, and final wash at 22° C.; (iii) hybridization solution of $6 \times SSC$ and 1% SDS or 3 M TMACl, 0.01 M sodium phosphate (pH 6.8), 1 mM EDTA (pH 7.6), 0.5% SDS, 100 $\mu g/ml$ denatured salmon sperm DNA and 0.1% nonfat dried milk, hybridization temperature.

The detection of hybrid duplexes can be carried out by a number of methods. Typically, hybridization duplexes are separated from unhybridized nucleic acids and the labels bound to the duplexes are then detected. Such labels refer to radioactive, fluorescent, biological or enzymatic tags or labels of standard use in the art. A label can be conjugated to either the oligonucleotide probes or the nucleic acids derived from the biological sample.

Probes can be labeled according to numerous well known methods. Non-limiting examples of radioactive labels include 3H, 14C, 32P, and 35S. Non-limiting examples of detectable markers include ligands, fluorophores, chemiluminescent agents, enzymes, and antibodies. Other detectable markers for use with probes, which can enable an increase in sensitivity of the method of the invention, include biotin and radio-nucleotides. It will become evident to the person of ordinary skill that the choice of a particular label dictates the manner in which it is bound to the probe.

For example, oligonucleotides of the present invention can be labeled subsequent to synthesis, by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent. Alternatively, when fluorescently-labeled oligonucleotide probes are used, fluorescein, lissamine, phycoerythrin, rhodamine (Perkin Elmer Cetus), Cy2, Cy3, Cy3.5, Cy5, Cy5.5, Cy7, FluorX (Amersham) and others [e.g., Kricka et al. (1992), Academic Press San Diego, Calif.] can be attached to the oligonucleotides.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays. For instance, samples may be hybridized to an irrelevant probe and treated with RNAse A prior to hybridization, to assess false hybridization.

Although the present invention is not specifically dependent on the use of a label for the detection of a particular nucleic acid sequence, such a label might be beneficial, by increasing the sensitivity of the detection. Furthermore, it enables automation. Probes can be labeled according to numerous well known methods.

As commonly known, radioactive nucleotides can be incorporated into probes of the invention by several methods. Non-limiting examples of radioactive labels include $^3H$, $^{14}C$, $^{32}P$, and $^{35}S$.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays.

Probes of the invention can be utilized with naturally occurring sugar-phosphate backbones as well as modified backbones including phosphorothioates, dithionates, alkyl phosphonates and a-nucleotides and the like. Probes of the invention can be constructed of either ribonucleic acid (RNA) or deoxyribonucleic acid (DNA), and preferably of DNA.

NAT Assays

Detection of a nucleic acid of interest in a biological sample may also optionally be effected by NAT-based assays, which involve nucleic acid amplification technology, such as PCR for example (or variations thereof such as real-time PCR for example).

As used herein, a "primer" defines an oligonucleotide which is capable of annealing to (hybridizing with) a target sequence, thereby creating a double stranded region which can serve as an initiation point for DNA synthesis under suitable conditions.

Amplification of a selected, or target, nucleic acid sequence may be carried out by a number of suitable methods. See generally Kwoh et al., 1990, Am. Biotechnol. Lab. 8:14 Numerous amplification techniques have been described and can be readily adapted to suit particular needs of a person of ordinary skill. Non-limiting examples of amplification techniques include polymerase chain reaction (PCR), ligase chain reaction (LCR), strand displacement amplification (SDA), transcription-based amplification, the q3 replicase system and NASBA (Kwoh et al., 1989, Proc. Natl. Acad. Sci. USA 86, 1173-1177; Lizardi et al., 1988, BioTechnology 6:1197-1202; Malek et al., 1994, Methods Mol. Biol., 28:253-260; and Sambrook et al., 1989, supra).

The terminology "amplification pair" (or "primer pair") refers herein to a pair of oligonucleotides (oligos) of the present invention, which are selected to be used together in amplifying a selected nucleic acid sequence by one of a number of types of amplification processes, preferably a polymerase chain reaction. Other types of amplification processes include ligase chain reaction, strand displacement amplification, or nucleic acid sequence-based amplification, as explained in greater detail below. As commonly known in the art, the oligos are designed to bind to a complementary sequence under selected conditions.

In one particular embodiment, amplification of a nucleic acid sample from a patient is amplified under conditions which favor the amplification of the most abundant differentially expressed nucleic acid. In one preferred embodiment, RT-PCR is carried out on an mRNA sample from a patient under conditions which favor the amplification of the most abundant mRNA. In another preferred embodiment, the amplification of the differentially expressed nucleic acids is carried out simultaneously. It will be realized by a person skilled in the art that such methods could be adapted for the detection of differentially expressed proteins instead of differentially expressed nucleic acid sequences.

The nucleic acid (i.e. DNA or RNA) for practicing the present invention may be obtained according to well known methods.

Oligonucleotide primers of the present invention may be of any suitable length, depending on the particular assay format and the particular needs and targeted genomes employed. Optionally, the oligonucleotide primers are at least 12 nucleotides in length, preferably between 15 and 24 molecules, and they may be adapted to be especially suited to a chosen nucleic acid amplification system. As commonly known in the art, the oligonucleotide primers can be designed by taking into consideration the melting point of hybridization thereof with its targeted sequence (Sambrook et al., 1989, Molecular Cloning—A Laboratory Manual, 2nd Edition, CSH Laboratories; Ausubel et al., 1989, in Current Protocols in Molecular Biology, John Wiley & Sons Inc., N.Y.).

It will be appreciated that antisense oligonucleotides may be employed to quantify expression of a splice isoform of interest. Such detection is effected at the pre-mRNA level. Essentially the ability to quantitate transcription from a splice site of interest can be effected based on splice site accessibility. Oligonucleotides may compete with splicing factors for the splice site sequences. Thus, low activity of the antisense oligonucleotide is indicative of splicing activity.

The polymerase chain reaction and other nucleic acid amplification reactions are well known in the art (various non-limiting examples of these reactions are described in greater detail below). The pair of oligonucleotides according to this aspect of the present invention are preferably selected to have compatible melting temperatures (Tm), e.g., melting temperatures which differ by less than that 7.degree. C., preferably less than 5.degree. C., more preferably less than 4.degree. C., most preferably less than 3.degree. C., ideally between 3.degree. C. and 0.degree. C.

Polymerase Chain Reaction (PCR): The polymerase chain reaction (PCR), as described in U.S. Pat. Nos. 4,683,195 and 4,683,202 to Mullis and Mullis et al., is a method of increasing the concentration of a segment of target sequence in a mixture of genomic DNA without cloning or purification. This technology provides one approach to the problems of low target sequence concentration. PCR can be used to directly increase the concentration of the target to an easily detectable level. This process for amplifying the target sequence involves the introduction of a molar excess of two oligonucleotide primers which are complementary to their respective strands of the double-stranded target sequence to the DNA mixture containing the desired target sequence. The mixture is denatured and then allowed to hybridize. Following hybridization, the primers are extended with polymerase so as to form complementary strands. The steps of denaturation, hybridization (annealing), and polymerase extension (elongation) can be repeated as often as needed, in order to obtain relatively high concentrations of a segment of the desired target sequence.

The length of the segment of the desired target sequence is determined by the relative positions of the primers with respect to each other, and, therefore, this length is a controllable parameter. Because the desired segments of the target sequence become the dominant sequences (in terms of concentration) in the mixture, they are said to be "PCR-amplified."

Ligase Chain Reaction (LCR or LAR): The ligase chain reaction [LCR; sometimes referred to as "Ligase Amplification Reaction" (LAR)] has developed into a well-recognized alternative method of amplifying nucleic acids. In LCR, four oligonucleotides, two adjacent oligonucleotides which uniquely hybridize to one strand of target DNA, and a complementary set of adjacent oligonucleotides, which hybridize to the opposite strand are mixed and DNA ligase is added to the mixture. Provided that there is complete complementarity at the junction, ligase will covalently link each set of hybridized molecules. Importantly, in LCR, two probes are ligated together only when they base-pair with sequences in the target sample, without gaps or mismatches. Repeated cycles of denaturation, and ligation amplify a short segment of DNA. LCR has also been used in combination with PCR to achieve enhanced detection of single-base changes: see for example Segev, PCT Publication No. W09001069 A1 (1990). However, because the four oligonucleotides used in this assay can pair to form two short ligatable fragments, there is the potential for the generation of target-independent background signal. The use of LCR for mutant screening is limited to the examination of specific nucleic acid positions.

Self-Sustained Synthetic Reaction (3SR/NASBA): The self-sustained sequence replication reaction (3SR) is a transcription-based in vitro amplification system that can exponentially amplify RNA sequences at a uniform temperature. The amplified RNA can then be utilized for mutation detection. In this method, an oligonucleotide primer is used to add a phage RNA polymerase promoter to the 5' end of the sequence of interest. In a cocktail of enzymes and substrates that includes a second primer, reverse transcriptase, RNase H, RNA polymerase and ribo-and deoxyribonucleoside triphosphates, the target sequence undergoes repeated rounds of transcription, cDNA synthesis and second-strand synthesis to amplify the area of interest. The use of 3SR to detect mutations is kinetically limited to screening small segments of DNA (e.g., 200-300 base pairs).

Q-Beta (Q.beta.) Replicase: In this method, a probe which recognizes the sequence of interest is attached to the replicatable RNA template for Q.beta. replicase. A previously identified major problem with false positives resulting from the replication of unhybridized probes has been addressed through use of a sequence-specific ligation step. However, available thermostable DNA ligases are not effective on this RNA substrate, so the ligation must be performed by T4 DNA ligase at low temperatures (37 degrees C.). This prevents the use of high temperature as a means of achieving specificity as in the LCR, the ligation event can be used to detect a mutation at the junction site, but not elsewhere.

A successful diagnostic method must be very specific. A straight-forward method of controlling the specificity of nucleic acid hybridization is by controlling the temperature of the reaction. While the 3SR/NASBA, and Q.beta. systems are all able to generate a large quantity of signal, one or more of the enzymes involved in each cannot be used at high temperature (i.e., >55 degrees C). Therefore the reaction temperatures cannot be raised to prevent non-specific hybridization of the probes. If probes are shortened in order to make them melt more easily at low temperatures, the likelihood of having more than one perfect match in a complex genome increases. For these reasons, PCR and LCR currently dominate the research field in detection technologies.

The basis of the amplification procedure in the PCR and LCR is the fact that the products of one cycle become usable templates in all subsequent cycles, consequently doubling the population with each cycle. The final yield of any such doubling system can be expressed as: $(1+X)^n = y$, where "X" is the mean efficiency (percent copied in each cycle), "n" is the number of cycles, and "y" is the overall efficiency, or yield of the reaction. If every copy of a target DNA is utilized as a template in every cycle of a polymerase chain reaction, then the mean efficiency is 100%. If 20 cycles of PCR are performed, then the yield will be $2^{20}$, or 1,048,576 copies of the starting material. If the reaction conditions reduce the mean efficiency to 85%, then the yield in those 20 cycles will be only $1.85^{20}$, or 220,513 copies of the starting material. In other words, a PCR running at 85% efficiency will yield only 21% as much final product, compared to a reaction running at 100% efficiency. A reaction that is reduced to 50% mean efficiency will yield less than 1% of the possible product.

In practice, routine polymerase chain reactions rarely achieve the theoretical maximum yield, and PCRs are usually run for more than 20 cycles to compensate for the lower yield. At 50% mean efficiency, it would take 34 cycles to achieve the million-fold amplification theoretically possible in 20, and at lower efficiencies, the number of cycles required becomes prohibitive. In addition, any background products that amplify with a better mean efficiency than the intended target will become the dominant products.

Also, many variables can influence the mean efficiency of PCR, including target DNA length and secondary structure, primer length and design, primer and dNTP concentrations, and buffer composition, to name but a few. Contamination of the reaction with exogenous DNA (e.g., DNA spilled onto lab surfaces) or cross-contamination is also a major consideration. Reaction conditions must be carefully optimized for each different primer pair and target sequence, and the process can take days, even for an experienced investigator. The laboriousness of this process, including numerous technical considerations and other factors, presents a significant drawback to using PCR in the clinical setting. Indeed, PCR has yet to penetrate the clinical market in a significant way. The same concerns arise with LCR, as LCR must also be optimized to use different oligonucleotide sequences for each target sequence. In addition, both methods require expensive equipment, capable of precise temperature cycling.

Many applications of nucleic acid detection technologies, such as in studies of allelic variation, involve not only detection of a specific sequence in a complex background, but also the discrimination between sequences with few, or single, nucleotide differences. One method of the detection of allele-specific variants by PCR is based upon the fact that it is difficult for Taq polymerase to synthesize a DNA strand when there is a mismatch between the template strand and the 3' end of the primer. An allele-specific variant may be detected by the use of a primer that is perfectly matched with only one of the possible alleles; the mismatch to the other allele acts to prevent the extension of the primer, thereby preventing the amplification of that sequence. This method has a substantial limitation in that the base composition of the mismatch influences the ability to prevent extension across the mismatch, and certain mismatches do not prevent extension or have only a minimal effect.

A similar 3'-mismatch strategy is used with greater effect to prevent ligation in the LCR. Any mismatch effectively blocks the action of the thermostable ligase, but LCR still has the drawback of target-independent background ligation products initiating the amplification. Moreover, the combination of PCR with subsequent LCR to identify the nucleotides at individual positions is also a clearly cumbersome proposition for the clinical laboratory.

The direct detection method according to various preferred embodiments of the present invention may be, for example a cycling probe reaction (CPR) or a branched DNA analysis.

When a sufficient amount of a nucleic acid to be detected is available, there are advantages to detecting that sequence directly, instead of making more copies of that target, (e.g., as in PCR and LCR). Most notably, a method that does not amplify the signal exponentially is more amenable to quantitative analysis. Even if the signal is enhanced by attaching multiple dyes to a single oligonucleotide, the correlation between the final signal intensity and amount of target is direct. Such a system has an additional advantage that the products of the reaction will not themselves promote further reaction, so contamination of lab surfaces by the products is not as much of a concern. Recently devised techniques have sought to eliminate the use of radioactivity and/or improve the sensitivity in automatable formats. Two examples are the "Cycling Probe Reaction" (CPR), and "Branched DNA" (bDNA).

Cycling probe reaction (CPR): The cycling probe reaction (CPR), uses a long chimeric oligonucleotide in which a central portion is made of RNA while the two termini are made of DNA. Hybridization of the probe to a target DNA and exposure to a thermostable RNase H causes the RNA portion to be digested. This destabilizes the remaining DNA portions of the duplex, releasing the remainder of the probe from the target DNA and allowing another probe molecule to repeat the process. The signal, in the form of cleaved probe molecules, accumulates at a linear rate. While the repeating process increases the signal, the RNA portion of the oligonucleotide is vulnerable to RNases that may carried through sample preparation.

Branched DNA: Branched DNA (bDNA), involves oligonucleotides with branched structures that allow each individual oligonucleotide to carry 35 to 40 labels (e.g., alkaline phosphatase enzymes). While this enhances the signal from a hybridization event, signal from non-specific binding is similarly increased.

The detection of at least one sequence change according to various preferred embodiments of the present invention may be accomplished by, for example restriction fragment length polymorphism (RFLP analysis), allele specific oligonucleotide (ASO) analysis, Denaturing/Temperature Gradient Gel Electrophoresis (DGGE/TGGE), Single-Strand Conformation Polymorphism (SSCP) analysis or Dideoxy fingerprinting (ddF).

The demand for tests which allow the detection of specific nucleic acid sequences and sequence changes is growing rapidly in clinical diagnostics. As nucleic acid sequence data for genes from humans and pathogenic organisms accumulates, the demand for fast, cost-effective, and easy-to-use tests for as yet mutations within specific sequences is rapidly increasing.

A handful of methods have been devised to scan nucleic acid segments for mutations. One option is to determine the entire gene sequence of each test sample (e.g., a bacterial isolate). For sequences under approximately 600 nucleotides, this may be accomplished using amplified material (e.g., PCR reaction products). This avoids the time and expense associated with cloning the segment of interest. However, specialized equipment and highly trained personnel are required, and the method is too labor-intense and expensive to be practical and effective in the clinical setting.

In view of the difficulties associated with sequencing, a given segment of nucleic acid may be characterized on several other levels. At the lowest resolution, the size of the molecule can be determined by electrophoresis by comparison to a known standard run on the same gel. A more detailed picture of the molecule may be achieved by cleavage with combinations of restriction enzymes prior to electrophoresis, to allow construction of an ordered map. The presence of specific sequences within the fragment can be detected by hybridization of a labeled probe, or the precise nucleotide sequence can be determined by partial chemical degradation or by primer extension in the presence of chain-terminating nucleotide analogs.

Restriction fragment length polymorphism (RFLP): For detection of single-base differences between like sequences, the requirements of the analysis are often at the highest level of resolution. For cases in which the position of the nucleotide in question is known in advance, several methods have been developed for examining single base changes without direct sequencing. For example, if a mutation of interest happens to fall within a restriction recognition sequence, a change in the pattern of digestion can be used as a diagnostic tool (e.g., restriction fragment length polymorphism [RFLP] analysis).

Single point mutations have been also detected by the creation or destruction of RFLPs. Mutations are detected and localized by the presence and size of the RNA fragments generated by cleavage at the mismatches. Single nucleotide mismatches in DNA heteroduplexes are also recognized and cleaved by some chemicals, providing an alternative strategy to detect single base substitutions, generically named the "Mismatch Chemical Cleavage" (MCC). However, this method requires the use of osmium tetroxide and piperidine, two highly noxious chemicals which are not suited for use in a clinical laboratory.

RFLP analysis suffers from low sensitivity and requires a large amount of sample. When RFLP analysis is used for the detection of point mutations, it is, by its nature, limited to the detection of only those single base changes which fall within a restriction sequence of a known restriction endonuclease. Moreover, the majority of the available enzymes have 4 to 6 base-pair recognition sequences, and cleave too frequently for many large-scale DNA manipulations. Thus, it is applicable only in a small fraction of cases, as most mutations do not fall within such sites.

A handful of rare-cutting restriction enzymes with 8 base-pair specificities have been isolated and these are widely used in genetic mapping, but these enzymes are few in number, are limited to the recognition of G+C-rich sequences, and cleave at sites that tend to be highly clustered. Recently, endonucleases encoded by group I introns have been discovered that might have greater than 12 base-pair specificity, but again, these are few in number.

Allele specific oligonucleotide (ASO): If the change is not in a recognition sequence, then allele-specific oligonucleotides (ASOs), can be designed to hybridize in proximity to the mutated nucleotide, such that a primer extension or ligation event can bused as the indicator of a match or a mismatch. Hybridization with radioactively labeled allelic specific oligonucleotides (ASO) also has been applied to the detection of specific point mutations. The method is based on the differences in the melting temperature of short DNA fragments differing by a single nucleotide. Stringent hybridization and washing conditions can differentiate between mutant and wild-type alleles. The ASO approach applied to PCR products also has been extensively utilized by various researchers to detect and characterize point mutations in ras genes and gsp/gip oncogenes. Because of the presence of various nucleotide changes in multiple positions, the ASO method requires the use of many oligonucleotides to cover all possible oncogenic mutations.

With either of the techniques described above (i.e., RFLP and ASO), the precise location of the suspected mutation must be known in advance of the test. That is to say, they are inapplicable when one needs to detect the presence of a mutation within a gene or sequence of interest.

Denaturing/Temperature Gradient Gel Electrophoresis (DGGE/TGGE): Two other methods rely on detecting changes in electrophoretic mobility in response to minor sequence changes. One of these methods, termed "Denaturing Gradient Gel Electrophoresis" (DGGE) is based on the observation that slightly different sequences will display different patterns of local melting when electrophoretically resolved on a gradient gel. In this manner, variants can be distinguished, as differences in melting properties of homoduplexes versus heteroduplexes differing in a single nucleotide can detect the presence of mutations in the target sequences because of the corresponding changes in their electrophoretic mobilities. The fragments to be analyzed, usually PCR products, are "clamped" at one end by a long stretch of G-C base pairs (30-80) to allow complete denaturation of the sequence of interest without complete dissociation of the strands. The attachment of a GC "clamp" to the DNA fragments increases the fraction of mutations that can be recognized by DGGE. Attaching a GC clamp to one primer is critical to ensure that the amplified sequence has a low dissociation temperature. Modifications of the technique have been developed, using temperature gradients, and the method can be also applied to RNA:RNA duplexes.

Limitations on the utility of DGGE include the requirement that the denaturing conditions must be optimized for each type of DNA to be tested. Furthermore, the method requires specialized equipment to prepare the gels and maintain the needed high temperatures during electrophoresis. The expense associated with the synthesis of the clamping tail on one oligonucleotide for each sequence to be tested is also a major consideration. In addition, long running times are required for DGGE. The long running time of DGGE was shortened in a modification of DGGE called constant denaturant gel electrophoresis (CDGE). CDGE requires that gels be performed under different denaturant conditions in order to reach high efficiency for the detection of mutations.

A technique analogous to DGGE, termed temperature gradient gel electrophoresis (TGGE), uses a thermal gradient rather than a chemical denaturant gradient. TGGE requires the use of specialized equipment which can generate a temperature gradient perpendicularly oriented relative to the electrical field. TGGE can detect mutations in relatively small fragments of DNA therefore scanning of large gene segments requires the use of multiple PCR products prior to running the gel.

Single-Strand Conformation Polymorphism (SSCP): Another common method, called "Single-Strand Conformation Polymorphism" (SSCP) was developed by Hayashi, Sekya and colleagues and is based on the observation that single strands of nucleic acid can take on characteristic conformations in non-denaturing conditions, and these conformations influence electrophoretic mobility. The complementary strands assume sufficiently different structures that one strand may be resolved from the other. Changes in sequences within the fragment will also change the conformation, consequently altering the mobility and allowing this to be used as an assay for sequence variations.

The SSCP process involves denaturing a DNA segment (e.g., a PCR product) that is labeled on both strands, followed by slow electrophoretic separation on a non-denaturing polyacrylamide gel, so that intra-molecular interactions can form and not be disturbed during the run. This technique is extremely sensitive to variations in gel composition and temperature. A serious limitation of this method is the relative difficulty encountered in comparing data generated in different laboratories, under apparently similar conditions.

Dideoxy fingerprinting (ddF): The dideoxy fingerprinting (ddF) is another technique developed to scan genes for the presence of mutations. The ddF technique combines components of Sanger dideoxy sequencing with SSCP. A dideoxy sequencing reaction is performed using one dideoxy terminator and then the reaction products are electrophoresed on nondenaturing polyacrylamide gels to detect alterations in mobility of the termination segments as in SSCP analysis. While ddF is an improvement over SSCP in terms of increased sensitivity, ddF requires the use of expensive dideoxynucleotides and this technique is still limited to the analysis of fragments of the size suitable for SSCP (i.e., fragments of 200-300 bases for optimal detection of mutations).

In addition to the above limitations, all of these methods are limited as to the size of the nucleic acid fragment that can be analyzed. For the direct sequencing approach, sequences of greater than 600 base pairs require cloning, with the consequent delays and expense of either deletion sub-cloning or primer walking, in order to cover the entire fragment. SSCP and DGGE have even more severe size limitations. Because of reduced sensitivity to sequence changes, these methods are not considered suitable for larger fragments. Although SSCP is reportedly able to detect 90% of single-base substitutions within a 200 base-pair fragment, the detection drops to less than 50% for 400 base pair fragments. Similarly, the sensitivity of DGGE decreases as the length of the fragment reaches 500 base-pairs. The ddF technique, as a combination of direct sequencing and SSCP, is also limited by the relatively small size of the DNA that can be screened.

According to a presently preferred embodiment of the present invention the step of searching for any of the nucleic acid sequences described here, in tumor cells or in cells derived from a cancer patient is effected by any suitable technique, including, but not limited to, nucleic acid sequencing, polymerase chain reaction, ligase chain reaction, self-sustained synthetic reaction, Q.beta.-Replicase, cycling probe reaction, branched DNA, restriction fragment length polymorphism analysis, mismatch chemical cleavage, heteroduplex analysis, allele-specific oligonucleotides, denaturing gradient gel electrophoresis, constant denaturant gel electrophoresis, temperature gradient gel electrophoresis and dideoxy fingerprinting.

Detection may also optionally be performed with a chip or other such device. The nucleic acid sample which includes the candidate region to be analyzed is preferably isolated, amplified and labeled with a reporter group. This reporter group can be a fluorescent group such as phycoerythrin. The labeled nucleic acid is then incubated with the probes immobilized on the chip using a fluidics station. describe the fabrication of fluidics devices and particularly microcapillary devices, in silicon and glass substrates.

Once the reaction is completed, the chip is inserted into a scanner and patterns of hybridization are detected. The hybridization data is collected, as a signal emitted from the reporter groups already incorporated into the nucleic acid, which is now bound to the probes attached to the chip. Since the sequence and position of each probe immobilized on the chip is known, the identity of the nucleic acid hybridized to a given probe can be determined.

It will be appreciated that when utilized along with automated equipment, the above described detection methods can be used to screen multiple samples for a disease and/or pathological condition both rapidly and easily.

Amino Acid Sequences and Peptides

The terms "polypeptide," "peptide" and "protein" are used interchangeably herein to refer to a polymer of amino acid residues. The terms apply to amino acid polymers in which one or more amino acid residue is an analog or mimetic of a corresponding naturally occurring amino acid, as well as to naturally occurring amino acid polymers. Polypeptides can be modified, e.g., by the addition of carbohydrate residues to form glycoproteins. The terms "polypeptide," "peptide" and "protein" include glycoproteins, as well as non-glycoproteins.

Polypeptide products can be biochemically synthesized such as by employing standard solid phase techniques. Such methods include but are not limited to exclusive solid phase synthesis, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Solid phase polypeptide synthesis procedures are well known in the art and further described by John Morrow Stewart and Janis Dillaha Young, Solid Phase Peptide Syntheses (2nd Ed., Pierce Chemical Company, 1984).

Synthetic polypeptides can optionally be purified by preparative high performance liquid chromatography [Creighton T. (1983) Proteins, structures and molecular principles. WH Freeman and Co. N.Y], after which their composition can be confirmed via amino acid sequencing.

In cases where large amounts of a polypeptide are desired, it can be generated using recombinant techniques such as described by Bitter et al., (1987) Methods in Enzymol. 153: 516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463.

The present invention also encompasses polypeptides encoded by the polynucleotide sequences of the present invention, as well as polypeptides according to the amino acid sequences described herein. The present invention also encompasses homologues of these polypeptides, such homologues can be at least 50%, at least 55%, at least 60%, at least 65%, at least 70%, at least 75%, at least 80%, at least 85%, at least 95% or more say 100% homologous to the amino acid sequences set forth below, as can be determined using BlastP software of the National Center of Biotechnology Information (NCBI) using default parameters, optionally and preferably including the following: filtering on (this option filters repetitive or low-complexity sequences from the query using the Seg (protein) program), scoring matrix is BLOSUM62 for proteins, word size is 3, E value is 10, gap costs are 11, 1 (initialization and extension), and number of alignments shown is 50. Finally, the present invention also encompasses fragments of the above described polypeptides and polypeptides having mutations, such as deletions, insertions or substitutions of one or more amino acids, either naturally occurring or artificially induced, either randomly or in a targeted fashion. Homology/identity of nucleic acid sequences is preferably determined by using BlastN software of the National Center of Biotechnology Information (NCBI) using default parameters, which preferably include using the DUST filter program, and also preferably include having an E value of 10, filtering low complexity sequences and a word size of 11.

It will be appreciated that peptides identified according to the present invention may be degradation products, synthetic peptides or recombinant peptides as well as peptidomimetics, typically, synthetic peptides and peptoids and semipeptoids which are peptide analogs, which may have, for example, modifications rendering the peptides more stable while in a body or more capable of penetrating into cells. Such modifications include, but are not limited to N terminus modification, C terminus modification, peptide bond modification, including, but not limited to, CH2-NH, CH2-S, CH2-S.dbd.O, O.dbd.C—NH, CH2-O, CH2-CH2, S.dbd.C—NH, CH.dbd.CH or CF.dbd.CH, backbone modifications, and residue modification. Methods for preparing peptidomimetic compounds are well known in the art and are specified. Further details in this respect are provided hereinunder.

Peptide bonds (—CO—NH—) within the peptide may be substituted, for example, by N-methylated bonds (—N(CH3)-CO—), ester bonds (—C(R)H—C—O—O—C(R)—N—), ketomethylen bonds (—CO—CH2-), .alpha.-aza bonds (—NH—N(R)—CO—), wherein R is any alkyl, e.g., methyl, carba bonds (—CH2-NH—), hydroxyethylene bonds (—CH(OH)—CH2-), thioamide bonds (—CS—NH—), olefinic double bonds (—CH.dbd.CH—), retro amide bonds (—NH—CO—), peptide derivatives (—N(R)—CH2-CO—), wherein R is the "normal" side chain, naturally presented on the carbon atom.

These modifications can occur at any of the bonds along the peptide chain and even at several (2-3) at the same time.

Natural aromatic amino acids, Trp, Tyr and Phe, may be substituted for synthetic non-natural acid such as Phenylglycine, TIC, naphthylelanine (Nol), ring-methylated derivatives of Phe, halogenated derivatives of Phe or o-methyl-Tyr.

In addition to the above, the peptides of the present invention may also include one or more modified amino acids or one or more non-amino acid monomers (e.g. fatty acids, complex carbohydrates etc).

As used herein in the specification and in the claims section below the term "amino acid" or "amino acids" is understood to include the 20 naturally occurring amino acids; those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine. Furthermore, the term "amino acid" includes both D- and L-amino acids.

Table 1 non-conventional or modified amino acids which can be used with the present invention. TABLE-US-00087 TABLE 1 Non-conventional amino acid Code Non-conventional amino acid Code .alpha.-aminobutyric acid Abu L-N-methylalanine Nmala .alpha.-amino-.alpha.-methylbutyrate Mgabu L-N-methylarginine Nmarg aminocyclopropane-Cpro L-N-methylasparagine Nmasn Carboxylate L-N-methylaspartic acid Nmasp aminoisobutyric acid Aib L-N-methylcysteine Nmcys aminonorbornyl-Norb L-N-methylglutamine Nmgin Carboxylate L-N-methylglutamic acid Nmglu Cyclohexylalanine Chexa L-N-methylhistidine Nmhis Cyclopentylalanine Cpen L-N-methylisolleucine Nmile D-alanine Dal L-N-methylleucine Nmleu D-arginine Darg L-N-methyllysine Nmlys D-aspartic acid Dasp L-N-methylmethionine Nmmet D-cysteine Dcys L-N-methyinorleucine Nmnle D-glutamine Dgln L-N-methylnorvaline Nmnva D-glutamic acid Dglu L-N-methylornithine Nmorn D-histidine Dhis L-N-methylphenylalanine Nmphe D-isoleucine Dile L-N-methylproline Nmpro D-leucine Dleu L-N-methylserine Nmser D-lysine Dlys L-N-methylthreonine Nmthr D-methionine Dmet L-N-methyltryptophan Nmtrp D-ornithine Dorn L-N-methyltyrosine Nmtyr D-phenylalanine Dphe L-N-methylvaline Nmval D-proline Dpro L-N-methylethylglycine Nmetg D-serine Dser L-N-methyl-t-butylglycine Nmtbug D-threonine Dthr L-norleucine Nle D-tryptophan Dtrp L-norvaline Nva D-tyrosine Dtyr .alpha.-methyl-aminoisobutyrate Maib D-valine Dval .alpha.-methyl-.gamma.-aminobutyrate Mgabu D-.alpha.-methylalanine Dmala .alpha.-methylcyclohexylalanine Mchexa D-.alpha.-methylarginine Dmarg .alpha.-methylcyclopentylalanine Mcpen D-.alpha.-methylasparagine Dmasn .alpha.-methyl-.alpha.-napthylalanine Manap D-.alpha.-methylaspartate Dmasp .alpha.-methylpenicillamine Mpen D-.alpha.-methylcysteine Dmcys N-(4-aminobutyl)glycine Nglu D-.alpha.-methylglutamine Dmgln N-(2-aminoethyl)glycine Naeg D-.alpha.-methylhistidine Dmhis N-(3-aminopropyl)glycine Norn D-.alpha.-methylisoleucine Dmile N-amino-.alpha.-methylbutyrate Nmaabu D-.alpha.-methylleucine Dmleu .alpha.-napthylalanine Anap D-.alpha.-methyllysine Dmlys N-benzylglycine Nphe D-.alpha.-methylmethionine Dmmet N-(2-carbamylethyl)glycine Ngln D-.alpha.-methylornithine Dmorn N-(carbamylmethyl)glycine Nasn D-.alpha.-methylphenylalanine Dmphe N-(2-carboxyethyl)glycine Nglu D-.alpha.-methylproline Dmpro N-(carboxymethyl)glycine Nasp D-.alpha.-methylserine Dmser N-cyclobutylglycine Ncbut D-.alpha.-methylthreonine Dmthr N-cycloheptylglycine Nchep D-.alpha.-methyltryptophan Dmtrp N-cyclohexylglycine Nchex D-.alpha.-methyltyrosine Dmty N-cyclodecylglycine Ncdec D-.alpha.-methylvaline Dmval N-cyclododeciglycine Ncdod D-.alpha.-methylalnine Dnmala N-cyclooctylglycine Ncoct D-.alpha.-methylarginine Dnmarg N-cyclopropylglycine Ncpro D-.alpha.-methylasparagine Dnmasn N-cycloundecylglycine Ncund D-.alpha.-methylasparatate Dnmasp N-(2, 2-diphenylethyl)glycine Nbhm D-.alpha.-methylcysteine Dnmcys N-(3,3-Nbhe diphenylpropyl)glycine D-N-methylleucine Dnmleu N-(3-indolylyethyl) glycine Nhtrp D-N-methyllysine Dnmlys N-methyl-.gamma.-aminobutyrate Nmgabu N-Nmchexa D-N-methylmethionine Dnmmet methylcyclohexylalanine D-N-methylornithine Dnmorn N-methylcyclopentylalanine Nmcpen N-methylglycine Nala D-N-methylphenylalanine Dnmphe N-methylaminoisobutyrate Nmaib D-N-methylproline Dnmpro N-(1-methylpropyl)glycine Nile D-N-methylserine Dnmser N-(2-methylpropyl)glycine Nile D-N-methylserine Dnmser N-(2-methylpropyl)glycine Nleu D-N-methylthreonine Dnmthr D-N-methyltryptophan Dnmtrp N-(1-methylethyl)glycine Nva D-N-methyltyrosine Dnmtyr N-methyla-napthylalanine Nmanap D-N-methylvaline Dnmval N-methylpenicillamine Nmpen .gamma.-aminobutyric acid Gabu N-(p-hydroxyphenyl)glycine Nhtyr L-t-butylglycine Tbug N-(thiomethyl)glycine Ncys L-ethylglycine Etg penicillamine Pen L-homophenylalanine Hphe L-.alpha.-methylalanine Mala L-.alpha.-methylarginine Marg L-.alpha.-methylasparagine Masn L-.alpha.-methylaspartate Masp L-.alpha.-methyl-t-butylglycine Mtbug L-.alpha.-methylcysteine Mcys L-methylethylglycine Metg L-.alpha.-methylglutamine Mgln L-.alpha.-methylglutamate Mglu L-.alpha.-methylhistidine Mhis L-.alpha.-methylhomo Mhphe phenylalanine L-.alpha.-methylisoleucine Mile N-(2-methylthioethyl)glycine Nmet D-N-methylglutamine Dnmgln N-(3-Narg guanidinopropyl) glycine D-N-methylglutamate Dnmglu N-(1-hydroxyethyl) glycine Nthr D-N-methylhistidine Dnmhis N-(hydroxyethyl) glycine Nser D-N-methylisoleucine Dnmile N-(imidazolylethyl)glycine Nhis D-N-methylleucine Dnmleu N-(3-indolylyethyl)glycine Nhtrp D-N-methyllysine Dnmlys N-methyl-.gamma.-aminobutyrate Nmgabu N-Nmchexa D-N-methylmethionine Dnmmet methylcyclohexylalanine D-N-methylornithine Dnmorn N-methylcyclopentylalanine Nmcpen N-methylglycine Nala D-N-methylphenylalanine Dnmphe N-methylaminoisobutyrate Nmaib D-N-methylproline Dnmpro N-(1-methylpropyl)glycine Nile D-N-methylserine Dnmser N-(2-methylpropyl)glycine Nleu D-N-methylthreonine Dnmthr D-N-methyltryptophan Dnmtrp N-(1-methylethyl)glycine Nval D-N-methyltyrosine Dnmtyr N-methyla-napthylalanine Nmanap D-N-methylvaline Dnmval N-methylpenicillamine Nmpen .gamma.-aminobutyric acid Gabu N-(p-hydroxyphenyl)glycine Nhtyr L-t-butylglycine Tbug N-(thiomethyl)glycine Ncys L-ethylglycine Etg penicillamine Pen L-homophenylalanine Hphe L-.alpha.-methylalanine Mala L-.alpha.-methylarginine Marg L-.alpha.-methylasparagine Masn L-.alpha.-methylaspartate Masp L-.alpha.-methyl-t-butylglycine Mtbug L-.alpha.-methylcysteine Mcys L-methylethylglycine Metg L-.alpha.-methylglutamine Mgln L-.alpha.-methylglutamate Mglu L-.alpha.-methylhistidine Mhis L-.alpha.-Mhphe methylhomophenylalanine L-.alpha.-methylisoleucine Mile N-(2-methylthioethyl)glycine Nmet L-.alpha.-methylleucine Mleu L-.alpha.-methyllysine Mlys L-.alpha.-methylmethionine Mmet L-.alpha.-methylnorleucine Mnle L-.alpha.-methylnorvaline Mnva L-.alpha.-methylornithine Morn L-.alpha.-methylphenylalanine Mphe L-.alpha.-methylproline Mpro L-.alpha.-methylserine mser L-.alpha.-methylthreonine Mthr L-.alpha.-methylvaline Mtrp L-.alpha.-methyltyrosine Mtyr L-.alpha.-methylleucine Mval L-N-Nmhphe Nnbhm methylhomophenylalanine N-(N-(2,2-diphenylethyl) N-(N-(3,3-diphenylpropyl) carbamylmethylglycine Nnbhm carbamylmethyl(1)glycine Nnbhe 1-carboxy-1-(2,2-diphenylethylamino) Nmbc cyclopropane Since the peptides of the present invention are preferably utilized in diagnostics which require the peptides to be in soluble form, the peptides of the present invention preferably include one or more non-natural or natural polar amino acids, including but not limited to serine and threonine which are capable of increasing peptide solubility due to their hydroxyl-containing side chain.

The peptides of the present invention are preferably utilized in a linear form, although it will be appreciated that in cases where cyclicization does not severely interfere with peptide characteristics, cyclic forms of the peptide can also be utilized.

The peptides of present invention can be biochemically synthesized such as by using standard solid phase techniques. These methods include exclusive solid phase synthesis well known in the art, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Synthetic peptides can be purified by preparative high performance liquid chromatography and the composition of which can be confirmed via amino acid sequencing.

In cases where large amounts of the peptides of the present invention are desired, the peptides of the present invention can be generated using recombinant techniques such as described by Bitter et al., (1987) Methods in Enzymol. 153: 516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463 and also as described above.

Antibodies

"Antibody" refers to a polypeptide ligand that is preferably substantially encoded by an immunoglobulin gene or immunoglobulin genes, or fragments thereof, which specifically binds and recognizes an epitope (e.g., an antigen). The recognized immunoglobulin genes include the kappa and lambda light chain constant region genes, the alpha, gamma, delta, epsilon and mu heavy chain constant region genes, and the myriad-immunoglobulin variable region genes. Antibodies exist, e.g., as intact immunoglobulins or as a number of well characterized fragments produced by digestion with various peptidases. This includes, e.g., Fab' and F(ab)'.sub.2 fragments. The term "antibody," as used herein, also includes antibody fragments either produced by the modification of whole antibodies or those synthesized de novo using recombinant DNA methodologies. It also includes polyclonal antibodies, monoclonal antibodies, chimeric antibodies, humanized antibodies, or single chain antibodies. "Fc" portion of an antibody refers to that portion of an immunoglobulin heavy chain that comprises one or more heavy chain constant region domains, CH1, CH2 and CH3, but does not include the heavy chain variable region.

The functional fragments of antibodies, such as Fab, F(ab')2, and Fv that are capable of binding to macrophages, are described as follows: (1) Fab, the fragment which contains a monovalent antigen-binding fragment of an antibody molecule, can be produced by digestion of whole antibody with the enzyme papain to yield an intact light chain and a portion of one heavy chain; (2) Fab', the fragment of an antibody molecule that can be obtained by treating whole antibody with pepsin, followed by reduction, to yield an intact light chain and a portion of the heavy chain; two Fab' fragments are obtained per antibody molecule; (3) (Fab')2, the fragment of the antibody that can be obtained by treating whole antibody with the enzyme pepsin without subsequent reduction; F(ab')2 is a dimer of two Fab' fragments held together by two disulfide bonds; (4) Fv, defined as a genetically engineered fragment containing the variable region of the light chain and the variable region of the heavy chain expressed as two chains; and (5) Single chain antibody ("SCA"), a genetically engineered molecule containing the variable region of the light chain and the variable region of the heavy chain, linked by a suitable polypeptide linker as a genetically fused single chain molecule.

Methods of producing polyclonal and monoclonal antibodies as well as fragments thereof are well known in the art (See for example, Harlow and Lane, Antibodies: A Laboratory Manual, Cold Spring Harbor Laboratory, New York, 1988, incorporated herein by reference).

Antibody fragments according to the present invention can be prepared by proteolytic hydrolysis of the antibody or by expression in E. coli or mammalian cells (e.g. Chinese hamster ovary cell culture or other protein expression systems) of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')2. This fragment can be further cleaved using a thiol reducing agent, and optionally a blocking group for the sulfhydryl groups resulting from cleavage of disulfide linkages, to produce 3.5S Fab' monovalent fragments. Alternatively, an enzymatic cleavage using pepsin produces two monovalent Fab' fragments and an Fc fragment directly. These methods are described, for example, by Goldenberg, U.S. Pat. Nos. 4,036,945 and 4,331,647, and references contained therein, which patents are hereby incorporated by reference in their entirety. See also Porter, R. R. [Biochem. J. 73: 119-126 (1959)]. Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

Fv fragments comprise an association of VH and VL chains. This association may be noncovalent, as described in Inbar et al. [Proc. Nat'l Acad. Sci. USA 69:2659-62 (1972)]. Alternatively, the variable chains can be linked by an intermolecular disulfide bond or cross-linked by chemicals such as glutaraldehyde. Preferably, the Fv fragments comprise VH and VL chains connected by a peptide linker. These single-chain antigen binding proteins (sFv) are prepared by constructing a structural gene comprising DNA sequences encoding the VH and VL domains connected by an oligonucleotide. The structural gene is inserted into an expression vector, which is subsequently introduced into a host cell such as E. coli. The recombinant host cells synthesize a single polypeptide chain with a linker peptide bridging the two V domains. Methods for producing sFvs are described, for example, by [Whitlow and Filpula, Methods 2: 97-105 (1991); Bird et al., Science 242:423-426 (1988); Pack et al., Bio/Technology 11:1271-77 (1993); and U.S. Pat. No. 4,946,778, which is hereby incorporated by reference in its entirety.

Another form of an antibody fragment is a peptide coding for a single complementarity-determining region (CDR). CDR peptides ("minimal recognition units") can be obtained by constructing genes encoding the CDR of an antibody of interest. Such genes are prepared, for example, by using the polymerase chain reaction to synthesize the variable region from RNA of antibody-producing cells. See, for example, Larrick and Fry [Methods, 2: 106-10 (1991)].

Humanized forms of non-human (e.g., murine) antibodies are chimeric molecules of immunoglobulins, immunoglobulin chains or fragments thereof (such as Fv, Fab, Fab', F(ab') or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., Nature, 321: 522-525 (1986); Riechmann et al., Nature, 332:323-329 (1988); and Presta, Curr. Op. Struct. Biol., 2:593-596 (1992)].

Methods for humanizing non-human antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and co-workers [Jones et al., Nature, 321:522-525 (1986); Riechmann et al., Nature 332:323-327 (1988); Verhoeyen et al., Science, 239:1534-1536 (1988)], by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991); Marks et al., J. Mol. Biol., 222:581 (1991)]. The techniques of Cole et al. and Boerner et al. are also available for the preparation of human monoclonal antibodies (Cole et al., Monoclonal Antibodies and Cancer Therapy, Alan R. Liss, p. 77 (1985) and Boerner et al., J. Immunol., 147(1):86-95 (1991)]. Similarly, human antibodies can be made by introduction of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., Bio/Technology 10,: 779-783 (1992); Lonberg et al., Nature 368: 856-859 (1994); Morrison, Nature 368 812-13 (1994); Fishwild et al., Nature Biotechnology 14, 845-51 (1996); Neuberger, Nature Biotechnology 14: 826 (1996); and-Lonberg and Huszar, Intern. Rev. Immunol. 13, 65-93 (1995).

Preferably, the antibody of this aspect of the present invention specifically binds at least one epitope of the polypeptide variants of the present invention. As used herein, the term "epitope" refers to any antigenic determinant on an antigen to which the paratope of an antibody binds.

Epitopic determinants usually consist of chemically active surface groupings of molecules such as amino acids or carbohydrate side chains and usually have specific three dimensional structural characteristics, as well as specific charge characteristics.

Optionally, a unique epitope may be created in a variant due to a change in one or more post-translational modifications, including but not limited to glycosylation and/or phosphorylation, as described below. Such a change may also cause a new epitope to be created, for example through removal of glycosylation at a particular site.

An epitope according to the present invention may also optionally comprise part or all of a unique sequence portion of a variant according to the present invention in combination with at least one other portion of the variant which is not contiguous to the unique sequence portion in the linear polypeptide itself, yet which are able to form an epitope in combination. One or more unique sequence portions may optionally combine with one or more other non-contiguous portions of the variant (including a portion which may have high homology to a portion of the known protein) to form an epitope.

Immunoassays

In another embodiment of the present invention, an immunoassay can be used to qualitatively or quantitatively detect and analyze markers in a sample. This method comprises: providing an antibody that specifically binds to a marker; contacting a sample with the antibody; and detecting the presence of a complex of the antibody bound to the marker in the sample.

To prepare an antibody that specifically binds to a marker, purified protein markers can be used. Antibodies that specifically bind to a protein marker can be prepared using any suitable methods known in the art.

After the antibody is provided, a marker can be detected and/or quantified using any of a number of well recognized immunological binding assays. Useful assays include, for example, an enzyme immune assay (EIA) such as enzyme-linked immunosorbent assay (ELISA), a radioimmune assay (RIA), a Western blot assay, or a slot blot assay see, e.g., U.S. Pat. Nos. 4,366,241; 4,376,110; 4,517,288; and 4,837,168). Generally, a sample obtained from a subject can be contacted with the antibody that specifically binds the marker.

Optionally, the antibody can be fixed to a solid support to facilitate washing and subsequent isolation of the complex, prior to contacting the antibody with a sample. Examples of solid supports include but are not limited to glass or plastic in the form of, e.g., a microtiter plate, a stick, a bead, or a microbead. Antibodies can also be attached to a solid support.

After incubating the sample with antibodies, the mixture is washed and the antibody-marker complex formed can be detected. This can be accomplished by incubating the washed mixture with a detection reagent. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

Throughout the assays, incubation and/or washing steps may be required after each combination of reagents. Incubation steps can vary from about 5 seconds to several hours, preferably from about 5 minutes to about 24 hours. However, the incubation time will depend upon the assay format, marker, volume of solution, concentrations and the like. Usually the assays will be carried out at ambient temperature, although they can be conducted over a range of temperatures, such as 10.degree. C. to 40.degree. C.

The immunoassay can be used to determine a test amount of a marker in a sample from a subject. First, a test amount of a marker in a sample can be detected using the immunoassay methods described above. If a marker is present in the sample, it will form an antibody-marker complex with an antibody that specifically binds the marker under suitable incubation conditions described above. The amount of an antibody-marker complex can optionally be determined by comparing to a standard. As noted above, the test amount of marker need not be measured in absolute units, as long as the unit of measurement can be compared to a control amount and/or signal.

Preferably used are antibodies which specifically interact with the polypeptides of the present invention and not with wild type proteins or other isoforms thereof, for example. Such antibodies are directed, for example, to the unique sequence portions of the polypeptide variants of the present invention, including but not limited to bridges, heads, tails and insertions described in greater detail below. Preferred embodiments of antibodies according to the present invention are described in greater detail with regard to the section entitled "Antibodies".

Radio-immunoassay (RIA): In one version, this method involves precipitation of the desired substrate and in the methods detailed hereinbelow, with a specific antibody and radio-labelled antibody binding protein (e.g., protein A labeled with $I^{125}$) immobilized on a precipitable carrier such as agarose beads. The number of counts in the precipitated pellet is proportional to the amount of substrate.

In an alternate version of the RIA, a labeled substrate and an unlabelled antibody binding protein are employed. A sample containing an unknown amount of substrate is added in varying amounts. The decrease in precipitated counts from the labeled substrate is proportional to the amount of substrate in the added sample.

Enzyme linked immunosorbent assay (ELISA): This method involves fixation of a sample (e.g., fixed cells or a proteinaceous solution) containing a protein substrate to a surface such as a well of a microtiter plate. A substrate specific antibody coupled to an enzyme is applied and allowed to bind to the substrate. Presence of the antibody is then detected and quantitated by a calorimetric reaction employing the enzyme coupled to the antibody. Enzymes commonly employed in this method include horseradish peroxidase and alkaline phosphatase. If well calibrated and within the linear range of response, the amount of substrate present in the sample is proportional to the amount of color produced. A substrate standard is generally employed to improve quantitative accuracy.

Western blot: This method involves separation of a substrate from other protein by means of an acrylamide gel followed by transfer of the substrate to a membrane (e.g., nylon or PVDF). Presence of the substrate is then detected by antibodies specific to the substrate, which are in turn detected by antibody binding reagents. Antibody binding reagents may be, for example, protein A, or other antibodies. Antibody binding reagents may be radiolabelled or enzyme linked as described hereinabove. Detection may be by autoradiography, colorimetric reaction or chemiluminescence. This method allows both quantitation of an amount of substrate and determination of its identity by a relative position on the membrane which is indicative of a migration distance in the acrylamide gel during electrophoresis.

Immunohistochemical analysis: This method involves detection of a substrate in situ in fixed cells by substrate specific antibodies. The substrate specific antibodies may be enzyme linked or linked to fluorophores. Detection is by microscopy and subjective evaluation. If enzyme linked antibodies are employed, a calorimetric reaction may be required.

Fluorescence activated cell sorting (FACS): This method involves detection of a substrate in situ in cells by substrate specific antibodies. The substrate specific antibodies are linked to fluorophores. Detection is by means of a cell sorting machine which reads the wavelength of light emitted from each cell as it passes through a light beam. This method may employ two or more antibodies simultaneously.

Radio-Imaging Methods

These methods include but are not limited to, positron emission tomography (PET) single photon emission computed tomography (SPECT). Both of these techniques are non-invasive, and can be used to detect and/or measure a wide variety of tissue events and/or functions, such as detecting cancerous cells for example. Unlike PET, SPECT can optionally be used with two labels simultaneously. SPECT has some other advantages as well, for example with regard to cost and the types of labels that can be used. For example, U.S. Pat. No. 6,696,686 describes the use of SPECT for detection of breast cancer, and is hereby incorporated by reference as if fully set forth herein.

Display Libraries

According to still another aspect of the present invention there is provided a display library comprising a plurality of display vehicles (such as phages, viruses or bacteria) each displaying at least 6, at least 7, at least 8, at least 9, at least 10, 10-15, 12-17, 15-20, 15-30 or 20-50 consecutive amino acids derived from the polypeptide sequences of the present invention.

Methods of constructing such display libraries are well known in the art. Such methods are described in, for example, Young A C, et al., "The three-dimensional structures of a polysaccharide binding antibody to Cryptococcus neoformans and its complex with a peptide from a phage display library: implications for the identification of peptide mimotopes" J Mol Biol Dec. 12, 1997; 274(4):622-34; Giebel L B et al. "Screening of cyclic peptide phage libraries identifies ligands that bind streptavidin with high affinities" Biochemistry Nov. 28, 1995;34(47):15430-5; Davies E L et al., "Selection of specific phage-display antibodies using libraries derived from chicken immunoglobulin genes" J Immunol Methods Oct. 12, 1995;186(1):125-35; Jones C R T al. "Current trends in molecular recognition and bioseparation" J Chromatogr A Jul. 14, 1995; 707(1):3-22; Deng S J et al. "Basis for selection of improved carbohydrate-binding single-chain antibodies from synthetic gene libraries" Proc Natl Acad Sci USA May 23, 1995; 92(11):4992-6; and Deng S J et al. "Selection of antibody single-chain variable fragments with improved carbohydrate binding by phage display" J Biol Chem Apr. 1, 1994; 269(13):9533-8, which are incorporated herein by reference.

The following sections relate to Candidate Marker Examples (first section) and to Experimental Data for these Marker Examples (second section).

CANDIDATE MARKER EXAMPLES SECTION

This Section relates to Examples of sequences according to the present invention, including illustrative methods of selection thereof.

Description of the Methodology Undertaken to Uncover the Biomolecular Sequences of the Present Invention Human ESTs and cDNAs were obtained from GenBank versions 136 (Jun. 15, 2003 ncbi.nih.gov/genbank/release-.notes/gb136.release.notes); NCBI genome assembly of April 2003; RefSeq sequences from June 2003; Genbank version 139 (December 2003); Human Genome from NCBI (Build 34) (from October 2003); and RefSeq sequences from December 2003; and from the LifeSeq library of Incyte Corporation (ESTs only; Wilmington, Del., USA). With regard to GenBank sequences, the human EST sequences from the EST (GBEST) section and the human mRNA sequences from the primate (GBPRI) section were used; also the human nucleotide RefSeq mRNA sequences were used (see for example ncbi.nlm.nih.gov/Genbank/GenbankOverview.html and for a reference to the EST section, see ncbi.nlm.nih.gov/dbEST/; a general reference to dbEST, the EST database in GenBank, may be found in Boguski et al, Nat Genet. August 1993; 4(4):332-3; all of which are hereby incorporated by reference as if fully set forth herein).

Novel splice variants were predicted using the LEADS clustering and assembly system as described in Sorek, R., Ast, G. & Graur, D. Alu-containing exons are alternatively spliced. Genome Res 12, 1060-7 (2002); U.S. Pat. No: 6,625, 545; and U.S. patent application Ser. No. 10/426,002, published as US20040101876 on May 27, 2004; all of which are hereby incorporated by reference as if fully set forth herein. Briefly, the software cleans the expressed sequences from repeats, vectors and immunoglobulins. It then aligns the expressed sequences to the genome taking alternatively splicing into account and clusters overlapping expressed sequences into "clusters" that represent genes or partial genes.

These were annotated using the GeneCarta (Compugen, Tel-Aviv, Israel) platform. The GeneCarta platform includes a rich pool of annotations, sequence information (particularly of spliced sequences), chromosomal information, alignments, and additional information such as SNPs, gene ontology terms, expression profiles, functional analyses, detailed domain structures, known and predicted proteins and detailed homology reports.

A brief explanation is provided with regard to the method of selecting the candidates. However, it should noted that this explanation is provided for descriptive purposes only, and is not intended to be limiting in any way. The potential markers were identified by a computational process that was designed to find genes and/or their splice variants that are over-expressed in tumor tissues, by using databases of expressed sequences. Various parameters related to the information in the EST libraries, determined according to a manual classification process, were used to assist in locating genes and/or splice variants thereof that are over-expressed in cancerous tissues. The detailed description of the selection method is presented in Example 1 below. The cancer biomarkers selection engine and the following wet validation stages are schematically summarized in FIG. 1.

Example 1

Identification of Differentially Expressed Gene Products—Algorithm

In order to distinguish between differentially expressed gene products and constitutively expressed genes (i.e., house keeping genes) an algorithm based on an analysis of frequencies was configured. A specific algorithm for identification of transcripts over expressed in cancer is described hereinbelow.

Dry Analysis

Library annotation—EST libraries are manually classified according to: [0592] (i) Tissue origin [0593] (ii) Biological source—Examples of frequently used biological sources for construction of EST libraries include cancer cell-lines; normal tissues; cancer tissues; fetal tissues; and others such as normal cell lines and pools of normal cell-lines, cancer cell-lines and combinations thereof. A specific description of abbreviations used below with regard to these tissues/cell lines etc is given above. [0594] (iii) Protocol of library construction—various methods are known in the art for library construction including normalized library construction; non-normalized library construction; subtracted libraries; ORESTES and others. It will be appreciated that at times the protocol of library construction is not indicated.

The following rules were followed:

EST libraries originating from identical biological samples are considered as a single library.

EST libraries which included above-average levels of contamination, such as DNA contamination for example, were eliminated. The presence of such contamination was determined as follows. For each library, the number of unspliced ESTs that are not fully contained within other spliced sequences was counted. If the percentage of such sequences (as compared to all other sequences) was at least 4 standard deviations above the average for all libraries being analyzed, this library was tagged as being contaminated and was eliminated from further consideration in the below analysis (see also Sorek, R. & Safer, H. M. A novel algorithm for computational identification of contaminated EST libraries. Nucleic Acids Res 31, 1067-74 (2003) for further details).

Clusters (genes) having at least five sequences including at least two sequences from the tissue of interest were analyzed. Splice variants were identified by using the LEADS software package as described above.

Example 2

Identification of Genes Over Expressed in Cancer

Two different scoring algorithms were developed.

Libraries score—candidate sequences which are supported by a number of cancer libraries, are more likely to serve as specific and effective diagnostic markers.

The basic algorithm—for each cluster the number of cancer and normal libraries contributing sequences to the cluster was counted. Fisher exact test was used to check if cancer libraries are significantly over-represented in the cluster as compared to the total number of cancer and normal libraries.

Library counting: Small libraries (e.g., less than 1000 sequences) were excluded from consideration unless they participate in the cluster. For this reason, the total number of libraries is actually adjusted for each cluster.

Clones no. score—Generally, when the number of ESTs is much higher in the cancer libraries relative to the normal libraries it might indicate actual over-expression.

The algorithm

Clone counting: For counting EST clones each library protocol class was given a weight based on our belief of how much the protocol reflects actual expression levels:

(i) non-normalized: 1
(ii) normalized: 0.2
(iii) all other classes: 0.1

Clones number score—The total weighted number of EST clones from cancer libraries was compared to the EST clones from normal libraries. To avoid cases where one library contributes to the majority of the score, the contribution of the library that gives most clones for a given cluster was limited to 2 clones.

The score was computed as c+1 C/n+1 N where:

c—weighted number of "cancer" clones in the cluster.
C—weighted number of clones in all "cancer" libraries.
n—weighted number of "normal" clones in the cluster.
N—weighted number of clones in all "normal" libraries.

Clones number score significance—Fisher exact test was used to check if EST clones from cancer libraries are significantly over-represented in the cluster as compared to the total number of EST clones from cancer and normal libraries.

Two search approaches were used to find either general cancer-specific candidates or tumor specific candidates.

Libraries/sequences originating from tumor tissues are counted as well as libraries originating from cancer cell-lines ("normal" cell-lines were ignored).

Only libraries/sequences originating from tumor tissues are counted

Example 3

Identification of Tissue Specific Genes

For detection of tissue specific clusters, tissue libraries/sequences were compared to the total number of libraries/sequences in cluster. Similar statistical tools to those described in above were employed to identify tissue specific genes. Tissue abbreviations are the same as for cancerous tissues, but are indicated with the header "normal tissue".

The algorithm—for each tested tissue T and for each tested cluster the following were examined:

1. Each cluster includes at least 2 libraries from the tissue T. At least 3 clones (weighed—as described above) from tissue T in the cluster; and 2. Clones from the tissue T are at least 40% from all the clones participating in the tested cluster Fisher exact test P-values were computed both for library and weighted clone counts to check that the counts are statistically significant.

Example 4

Identification of Splice Variants Expressed in Cancer of Clusters which are Not Over Expressed in Cancer Cancer-Specific Splice Variants Containing a Unique Region were Identified.

Identification of unique sequence regions in splice variants

A Region is defined as a group of adjacent exons that always appear or do not appear together in each splice variant.

A "segment" (sometimes referred also as "seg" or "node") is defined as the shortest contiguous transcribed region without known splicing inside.

Only reliable ESTs were considered for region and segment analysis. An EST was defined as unreliable if:
(i) Unspliced;
(ii) Not covered by RNA;
(iii) Not covered by spliced ESTs; and
(iv) Alignment to the genome ends in proximity of long poly-A stretch or starts in proximity of long poly-T stretch.

Only reliable regions were selected for further scoring. Unique sequence regions were considered reliable if:
(i) Aligned to the genome; and
(ii) Regions supported by more than 2 ESTs.

The algorithm

Each unique sequence region divides the set of transcripts into 2 groups:
(i) Transcripts containing this region (group TA).
(ii) Transcripts not containing this region (group TB).

The set of EST clones of every cluster is divided into 3 groups:
(i) Supporting (originating from) transcripts of group TA (S1).
(ii) Supporting transcripts of group TB (S2).
(iii) Supporting transcripts from both groups (S3).

Library and clones number scores described above were given to S1 group.

Fisher Exact Test P-values were used to check if:

S1 is significantly enriched by cancer EST clones compared to S2; and

S1 is significantly enriched by cancer EST clones compared to cluster background (S1+S2+S3).

Figure 2:
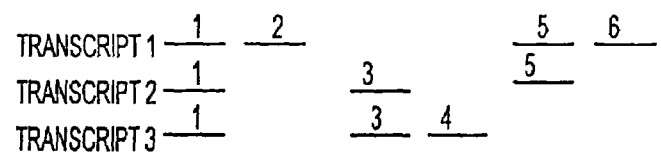
FIG. 2. Schematic illustration, depicting grouping of transcripts of a given cluster based on presence or absence of unique sequence regions.

Identification of unique sequence regions and division of the group of transcripts accordingly is illustrated in FIG. 2. Each of these unique sequence regions corresponds to a segment, also termed herein a "node".

Region 1: common to all transcripts, thus it is preferably not considered for determining differential expression between variants; Region 2: specific to Transcript 1; Region 3: specific to Transcripts 2+3; Region 4: specific to Transcript 3; Region 5: specific to Transcripts 1 and 2; Region 6: specific to Transcript 1.

Example 5

Identification of Cancer Specific Splice Variants of Genes Over Expressed in Cancer A search for EST supported (no mRNA) regions for genes of:
(i) known cancer markers
(ii) Genes shown to be over-expressed in cancer in published micro-array experiments.

Reliable EST supported-regions were defined as supported by minimum of one of the following:
(i) 3 spliced ESTs; or
(ii) 2 spliced ESTs from 2 libraries;
(iii) 10 unspliced ESTs from 2 libraries, or
(iv) 3 libraries.

Actual Marker Examples

The following examples relate to specific actual marker examples.

Experimental Examples Section

This Section relates to Examples describing experiments involving these sequences, and illustrative, non-limiting examples of methods, assays and uses thereof. The materials and experimental procedures are explained first, as all experiments used them as a basis for the work that was performed.

The markers of the present invention were tested with regard to their expression in various cancerous and non-cancerous tissue samples. A description of the samples used in the panel is provided in Table 1 below. A description of the samples used in the normal tissue panel is provided in Table 2 below. Tests were then performed as described in the "Materials and Experimental Procedures" section below. TABLE-US-00088 TABLE 1 Tissue samples in testing panel sample sex/rename Lot no source pathology grade age TNM stage 52-B-ILC G1 A605360 Biochain Invasive 1 F/60 Lobular Carcinoma 51-B-IDC G1 A605361 Biochain IDC 1 F/79 6-A-IDC G1 7238T ABS IDC 1 F/60 T2N0M0 stage 2A 7-A-IDC G2 7263T ABS IDC 2 F/43 T1N0M0 stage 1 12-A-IDC G2 1432T ABS IDC 2 F/46 T2N0M0 stage 2A 13-A-IDC G2A0133T ABS IDC 2 F/63 T2N1a Mx 14-A-IDC G2 A0135T ABS IDC 2 F/37 T2N2Mx 15-A-IDC G2 7259T ABS IDC 2 F/59 T3N1M0 stage 3A 16-A-IDC G2 4904020032T ABS IDC 2 NA T3N1Mx 17-A-IDC G2 4904020036T ABS IDC 2-3 NA T3N1Mx 43-B-IDC G2 A609183 Biochain IDC 2 F/40 44-B-IDC G2 A609198 Biochain IDC 2 F/77 45-B-IDC G2 A609181 Biochain IDC 2 F/58 48-B-IDC G2 A609222 Biochain IDC 2 F/44 49-B-IDC G2 A609223 Biochain IDC 2 F/54 50-B-IDC G2 A609224 Biochain IDC 2 F/69 53-B-IDC G2 A605151 Biochain IDC 2 F/44 54-B-IDC G2 A605353 Biochain IDC 2 F/41 55-B-IDC G2 A609179 Biochain IDC 2 F/42 61-B-IDC G2 A610029 Biochain IDC 2 F/46 62-B-IDC G2 A609194 Biochain IDC 2 F/51 47-B-IDC G2 A609221 Biochain IDC 2 46-B-Carci G2 A609177 Biochain Carcinoma 2 F/48 26-A-IDC G3 7249T ABS IDC 3 F/60 T2N0M0 stage 2A 27-A-IDC G3 4907020072T ABS IDC 3 NA T2N0Mx 42-A-IDC G3 6005020031T ABS IDC 3 NA T1cN0 Mx 31-CG-IDC CG-154 Ichilov IDC NA 32-A-Muc 7116T ABS Mucinous F/54 T2N0M0 stage Carci carcinoma 2A 35-A-N M6 7238N ABS Normal F/60 matched to 6T 36-A-N M7 7263N ABS Normal F/43 matched to 7T 39-A-N M15 7259N ABS Normal F/59 matched to 15T 40-A-N M12 1432N ABS Normal F/46 matched to 12T 41-A-N M26 7249N ABS Normal F/60 matched to 26T 56-B-N A609235 Biochain Normal F/59 PM 57-B-N A609233 Biochain Normal F/34 PM 58-B-N A609232 Biochain Normal F/65 PM 59-B-N A607155 Biochain Normal F/35 PM 60-B-N A609234 Biochain Normal F/36 PM 63-Am-N 26486 Ambion Normal PS F/43 64-Am-N 23036 Ambion Normal F/57 PM 65-Am-N 31410 Ambion Normal F/63 PM 66-Am-N 36678 Ambion Normal F/45 PM 67-Am-N 073P010602086A Ambion Normal F/64 PM TABLE-US-00089 TABLE 2 Tissue samples in normal panel: Lot no. Source Tissue Pathology Sex/Age 1-Am-Colon (C71) 071P10B Ambion Colon PM F/43 2-B-Colon (C69) A411078 Biochain Colon PM-Pool of 10 M&F 3-Cl-Colon (C70) 1110101 Clontech Colon PM-Pool of 3 M&F 4-Am-Small Intestine 091P0201A Ambion Small Intestine PM M/75 5-B-Small Intestine A501158 Biochain Small Intestine PM M/63 6-B-Rectum A605138 Biochain Rectum PM M/25 7-B-Rectum A610297 Biochain Rectum PM M/24 8-B-Rectum A610298 Biochain Rectum PM M/27 9-Am-Stomach 110P04A Ambion Stomach PM M/16 10-B-Stomach A501159 Biochain Stomach PM M/24 11-B-Esophagus A603814 Biochain Esophagus PM M/26 12-B-Esophagus A603813 Biochain Esophagus PM M/41 13-Am-Pancreas 071P25C Ambion Pancreas PM M/25 14-CG-Pancreas CG-255-2 Ichilov Pancreas PM M/75 15-B-Lung A409363 Biochain Lung PM F/26 16-Am-Lung (L93) 111P0103A Ambion Lung PM F/61 17-B-Lung (L92) A503204 Biochain Lung PM M/28 18-Am-Ovary (O47) 061P43A Ambion Ovary PM F/16 19-B-Ovary (O48) A504087 Biochain Ovary PM F/51 20-B-Ovary (O46) A504086 Biochain Ovary PM F/41 21-Am-Cervix 101P0101A Ambion Cervix PM F/40 22-B-Cervix A408211 Biochain Cervix PM F/36 23-B-Cervix A504089 Biochain Cervix PM-Pool of 5 M&F 24-B-Uterus A411074 Biochain Uterus PM-Pool of 10 M&F 25-B-Uterus A409248 Biochain Uterus PM F/43 26-B-Uterus A504090 Biochain Uterus PM-Pool of 5 M&F 27-B-Bladder A501157 Biochain Bladder PM M/29 28-Am-Bladder 071P02C Ambion Bladder PM M/20 29-B-Bladder A504088 Biochain Bladder PM-Pool of 5 M&F 30-Am-Placenta 021P33A Ambion Placenta PB F/33 31-B-Placenta A410165 Biochain Placenta PB F/26 32-B-Placenta A411073 Biochain Placenta PB-Pool of 5 M&F 33-B-Breast (B59) A607155 Biochain Breast PM F/36 34-Am-Breast (B63) 26486 Ambion Breast PM F/43 35-Am-Breast (B64) 23036 Ambion Breast PM F/57 36-Cl-Prostate (P53) 1070317 Clontech Prostate PB-Pool of 47 M&F 37-Am-Prostate (P42) 061P04A Ambion Prostate PM M/47 38-Am-Prostate (P59) 25955 Ambion Prostate PM M/62 39-Am-Testis 111P0104A Ambion Testis PM M/25 40-B-Testis A411147 Biochain Testis PM M/74 41-Cl-Testis 1110320 Clontech Testis PB-Pool of 45 M&F 42-CG-Adrenal CG-184-10 Ichilov Adrenal PM F/81 43-B-Adrenal A610374 Biochain Adrenal PM F/83 44-B-Heart A411077 Biochain Heart PB-Pool of 5 M&F 45-CG-Heart CG-255-9 Ichilov Heart PM M/75 46-CG-Heart CG-227-1 Ichilov Heart PM F/36 47-Am-Liver 081P0101A Ambion Liver PM M/64 48-CG-Liver CG-93-3 Ichilov Liver PM F/19 49-CG-Liver CG-124-4 Ichilov Liver PM F/34 50-Cl-BM 1110932 Clontech Bone Marrow PM-Pool of 8 M&F 51-CGEN-Blood WBC#5 CGEN Blood M 52-CGEN-Blood WBC#4 CGEN Blood M 53-CGEN-Blood WBC#3 CGEN Blood M 54-CG-Spleen CG-267 Ichilov Spleen PM F/25 55-CG-Spleen 111P0106B Ambion Spleen PM M/25 56-CG-Spleen A409246 Biochain Spleen PM F/12 56-CG-Thymus CG-98-7 Ichilov Thymus PM F/28 58-Am-Thymus 101P0101A Ambion Thymus PM M/14 59-B-Thymus A409278 Biochain Thymus PM M/28 60-B-Thyroid A610287 Biochain Thyroid PM M/27 61-B-Thyroid A610286 Biochain Thyroid PM M/24 62-CG-Thyroid CG-119-2 Ichilov Thyroid PM F/66 63-Cl-Salivary Gland 1070319 Clontech Salivary Gland PM-Pool of 24 M&F 64-Am-Kidney 111P0101B Ambion Kidney PM-Pool of 14 M&F 65-Cl-Kidney 1110970 Clontech Kidney PM-Pool of 14 M&F 66-B-Kidney A411080 Biochain Kidney PM-Pool of 5 M&F 67-CG-Cerebellum CG-183-5 Ichilov Cerebellum PM M/74 68-CG-Cerebellum CG-212-5 Ichilov Cerebellum PM M/54 69-B-Brain A411322 Biochain Brain PM M/28 70-Cl-Brain 1120022 Clontech Brain PM-Pool of 2 M&F 71-B-Brain A411079 Biochain Brain PM-Pool of 2 M&F 72-CG-Brain CG-151-1 Ichilov Brain PM F/86 73-Am-Skeletal Muscle 101P013A Ambion Skeletal Muscle PM F/28 74-Cl-Skeletal Muscle 1061038 Clontech Skeletal Muscle PM-Pool of 2 M&F Materials and Experimental Procedures RNA preparation—RNA was obtained from Clontech (Franklin Lakes, N.J. USA 07417, clontech.com), BioChain Inst. Inc. (Hayward, Calif. 94545 USA biochain.com), ABS (Wilmington, Del. 19801, USA, absbioreagents.com) or Ambion (Austin, Tex. 78744 USA, ambion.com). Alternatively, RNA was generated from tissue samples using TRI-Reagent (Molecular Research Center), according to Manufacturer's instructions. Tissue and RNA samples were obtained from patients or from postmortem. Total RNA samples were treated with DNaseI (Ambion) and purified using RNeasy columns (Qiagen).

RT PCR—Purified RNA (1 .mu.g) was mixed with 150 ng Random Hexamer primers (Invitrogen) and 500 .mu.M dNTP in a total volume of 15.6 .mu.l. The mixture was incubated for 5 min at 65.degree. C. and then quickly chilled on ice. Thereafter, 5 .mu.l of 5.times. SuperscriptII first strand buffer (Invitrogen), 2.4 .mu.l 0.1M DTT and 40 units RNasin (Promega) were added, and the mixture was incubated for 10 min at 25.degree. C., followed by further incubation at 42.degree. C. for 2 min. Then, 1 .mu.l (200 units) of SuperscriptII (Invitrogen) was added and the reaction (final volume of 25.mu.l) was incubated for 50 min at 42.degree. C. and then inactivated at 70.degree. C. for 15 min. The resulting cDNA was diluted 1:20 in TE buffer (10 mM Tris pH=8, 1 mM EDTA pH=8).

Figure 3:
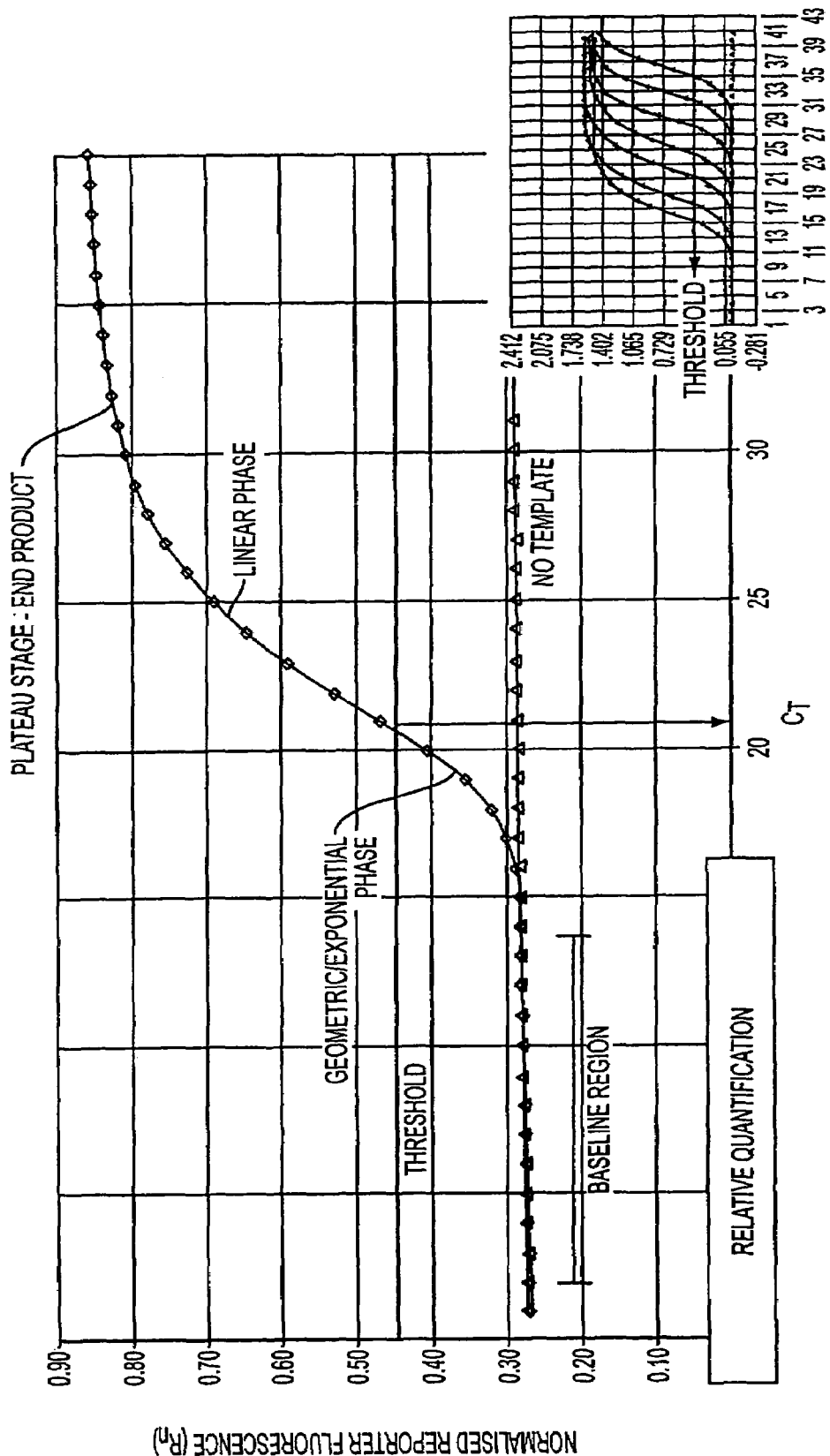
FIG. 3 is schematic summary of quantitative real-time PCR analysis.

Real-Time RT-PCR analysis—cDNA (5 .mu.l), prepared as described above, was used as a template in Real-Time PCR reactions using the SYBR Green I assay (PE Applied Biosystem) with specific primers and UNG Enzyme (Eurogentech or ABI or Roche). The amplification was effected as follows: 50.degree. C. for 2 min, 95.degree. C. for 10 min, and then 40 cycles of 95.degree. C. for 15 sec, followed by 60.degree. C. for 1 min. Detection was performed by using the PE Applied Biosystem SDS 7000. The cycle in which the reactions achieved a threshold level (Ct) of fluorescence was registered and was used to calculate the relative transcript quantity in the RT reactions. The relative quantity was calculated using the equation Q=efficiencyl .sup.-Ct. The efficiency of the PCR reaction was calculated from a standard curve, created by using serial dilutions of several reverse transcription (RT) reactions. To minimize inherent differences in the RT reaction, the resulting relative quantities were normalized to the geometric mean of the relative quantities of several housekeeping (HSKP) genes. Schematic summary of quantitative real-time PCR analysis is presented in FIG. 3. As shown, the x-axis shows the cycle number. The C.sub.T=Threshold Cycle point, which is the cycle that the amplification curve crosses the fluorescence threshold that was set in the experiment. This point is a calculated cycle number in which PCR product signal is above the background level (passive dye ROX) and still in the Geometric/Exponential phase (as shown, once the level of fluorescence crosses the measurement threshold, it has a geometrically increasing phase, during which measurements are most accurate, followed by a linear phase and a plateau phase; for quantitative measurements, the latter two phases do not provide accurate measurements). The y-axis shows the normalized reporter fluorescence. It should be noted that this type of analysis provides relative quantification.

The sequences of the housekeeping genes measured in all the examples on breast cancer panel were as follows: TABLE-US-00090 G6PD (GenBank Accession No. NM_000402 (SEQ ID NO: 918)) G6PD Forward primer: (SEQ ID NO: 919) gaggccgtcaccaagaacat G6PD Reverse primer: (SEQ ID NO: 920) ggacagccggtcagagctc G6PD-amplicon: (SEQ ID NO: 921) gaggccgtcaccaagaacattcacgagtcctgcatgagccagataggctggaaccgcatcatcgtggagaagcc-ctcgggagggacct gcagagctctgaccggctgtcc SDHA (GenBank Accession No. NM_004168 (SEQ ID NO: 922)) SDHA Forward primer: (SEQ ID NO: 923) TGGGAACAA-GAGGGCATCTG SDHA reverse primer: (SEQ ID NO: 924) CCACCACTGCATCAAATTCATG SDHA-amplicon: (SEQ ID NO: 925) TGGGAACAAGAGGGCATCT- GCTAAAGTTTCAGATTCCATTTCTGCT-CAGTATCCAGT AGTGGATCATGAATTTGATG-CAGTGGTGG PBGD (GenBank Accession No. BC019323, (SEQ ID NO: 926)) PBGD Forward primer: (SEQ ID NO: 927) TGAGAGTGATTCGCGTGGG PBGD Reverse primer: (SEQ ID NO: 928) CCAGGGTACGAG-GCTTTCAAT PBGD-amplicon: (SEQ ID NO: 929) TGAGAGTGATTCGCGTGGGTACCCGCAA-GAGCCAGCTTGCTCGCATACAGACGGAC AGTGTG-GTGGCAACATTGAAAGCCTCGTACCCTGG HPRT1 (GenBank Accession No. NM_000194, (SEQ ID NO: 930)) HPRT1 Forward primer: (SEQ ID NO: 931) TGACACTG-GCAAAACAATGCA HPRT1 reverse primer: (SEQ ID NO: 932) GGTCCTTTTCACCAGCAAGCT HPRT1-amplicon: (SEQ ID NO: 933) TGACACTGGCAAAACAATGCA-GACTTTGCTTTCCTTGGTCAGGCAGTATAATCCAA AGATGGTCAAGGTCGCAAGCTTGCTGGT-GAAAAGGACC The sequences of the housekeeping genes measured in all the examples on normal tissue samples panel were as follows: TABLE-US-00091 RPL19 (GenBank Accession No. NM_000981, (SEQ ID NO: 934)) RPL19 Forward primer: (SEQ ID NO: 935) TGGCAAGAAGAAGGTCTGGTTAG RPL19 reverse primer: (SEQ ID NO: 936) TGATCAGC-CCATCTTTGATGAG RPL19-amplicon: (SEQ ID NO: 937) TGGCAAGAAGAAGGTCTGGTTAGAC-CCCAATGAGACCAATGAAATCGCCAATGCCA ACTC-CCGTCAGCAGATCCGGAAGCTCATCAAA-GATGGGCTGATCA TATA box (GenBank Accession No. NM_003194, (SEQ ID NO: 938)) TATA box Forward primer: (SEQ ID NO: 939) CGGTTTGCTGCGGTAATCAT TATA box Reverse primer: (SEQ ID NO: 940) TTTCTTGCT-GCCAGTCTGGAC TATA box-amplicon: (SEQ ID NO: 941) CGGTTTGCTGCGGTAATCATGAGGATAA-GAGAGCCACGAACCACGGCACTGATTTT CAGT-TCTGGGAAAATGGTGTGCACAGGAGC-CAAGAGTGAAGAACAGTCCAGACTG GCAGCAAGAAA UBC (GenBank Accession No. BC000449 (SEQ ID NO: 942)) UBC Forward primer: (SEQ ID NO: 943) ATTTGGGTCGCGGTTCTTG UBC reverse primer: (SEQ ID NO: 944) TGCCTTGACATTCTC-GATGGT UBC-amplicon: (SEQ ID NO: 945) ATTTGGGTCGCGGTTCTTGTTTGTG-GATCGCTGTGATCGTCACTTGACAATGCAGAT CTTCGTGAAGACTCTGACTGGTAAGAC-CATCACCCTCGAGG TTGAGCCCAGTGACACCATC-GAGAATGTCAAGGCA SDHA (GenBank Accession No. NM_004168 (SEQ ID NO: 922)) SDHA Forward primer: (SEQ ID NO: 923) TGGGAACAAGAGGGCATCTG SDHA reverse primer: (SEQ ID NO: 924) CCACCACTGCAT-CAAATTCATG SDHA-amplicon: (SEQ ID NO: 925) TGG-GAACAAGAGGGCATCTGCTAAAGTTTCA-GATTCCATTTCTGCTCAGTATCCAGT AGTGGATCATGAATTTGATGCAGTGGTGG Oligonucleotide-Based Micro-Array Experiment Protocol Microarray Fabrication Microarrays (chips) were printed by pin deposition using the MicroGrid II MGII 600 robot from BioRobotics Limited (Cambridge, UK). 50-mer oligonucleotides target sequences were designed by Compugen Ltd (Tel-Aviv, IL) as described by A. Shoshan et al, "Optical technologies and informatics", Proceedings of SPIE. Vol 4266, pp. 86-95 (2001). The designed oligonucleotides were synthesized and purified by desalting with the Sigma-Genosys system (The Woodlands, Tex., US) and all of the oligonucleotides were joined to a C6 amino-modified linker at the 5' end, or being attached directly to CodeLink slides (Cat #25-6700-01. Amersham Bioscience, Piscataway, N.J., US). The 50-mer oligonucleotides, forming the target sequences, were first suspended in Ultrapure DDW (Cat # 01-866-1A Kibbutz Beit-Haemek, Israel) to a concentration of 50 .mu.M. Before printing the slides, the oligonucleotides were resuspended in 300 mM sodium phosphate (pH 8.5) to final concentration of 150 mM and printed at 35-40% relative humidity at 21.degree. C.

Each slide contained a total of 9792 features in 32 subarrays. Of these features, 4224 features were sequences of interest according to the present invention and negative controls that were printed in duplicate. An additional 288 features (96 target sequences printed in triplicate) contained housekeeping genes from Human Evaluation Library2, Compugen Ltd, Israel. Another 384 features are *E. coli* spikes 1-6, which are oligos to *E-Coli* genes which are commercially available in the Array Control product (Array control-sense oligo spots, Ambion Inc. Austin, Tex. Cat # 1781, Lot # 112K06).

Post-Coupling Processing of Printed Slides

After the spotting of the oligonucleotides to the glass (CodeLink) slides, the slides were incubated for 24 hours in a sealed saturated NaCl humidification chamber (relative humidity 70-75%).

Slides were treated for blocking of the residual reactive groups by incubating them in blocking solution at 50.degree. C. for 15 minutes (10 ml/slide of buffer containing 0.1M Tris, 50 mM ethanolamine, 0.1% SDS). The slides were then rinsed twice with Ultra-pure DDW (double distilled water). The slides were then washed with wash solution (10 ml/slide. 4.times.SSC, 0.1% SDS)) at 50.degree. C. for 30 minutes on the shaker. The slides were then rinsed twice with Ultra-pure DDW, followed by drying by centrifugation for 3 minutes at 800 rpm.

Next, in order to assist in automatic operation of the hybridization protocol, the slides were treated with Ventana Discovery hybridization station barcode adhesives. The printed slides were loaded on a Bio-Optica (Milan, Italy) hematology staining device and were incubated for 10 minutes in 50 ml of 3-Aminopropyl Triethoxysilane (Sigma A3648 lot #122K589). Excess fluid was dried and slides were then incubated for three hours in 20 mm/Hg in a dark vacuum desiccator (Pelco 2251, Ted Pella, Inc. Redding Calif.).

The following protocol was then followed with the Genisphere 900-RP (random primer), with mini elute columns on the Ventana Discovery HybStation.TM., to perform the microarray experiments. Briefly, the protocol was performed as described with regard to the instructions and information provided with the device itself. The protocol included cDNA synthesis and labeling. cDNA concentration was measured with the TBS-380 (Turner Biosystems. Sunnyvale, Calif.) PicoFlour, which is used with the OliGreen ssDNA Quantitation reagent and kit. Hybridization was performed with the Ventana Hybridization device, according to the provided protocols (Discovery Hybridization Station Tuscon Ariz.).

The slides were then scanned with GenePix 4000B dual laser scanner from Axon Instruments Inc, and analyzed by GenePix Pro 5.0 software.

Figure 4:
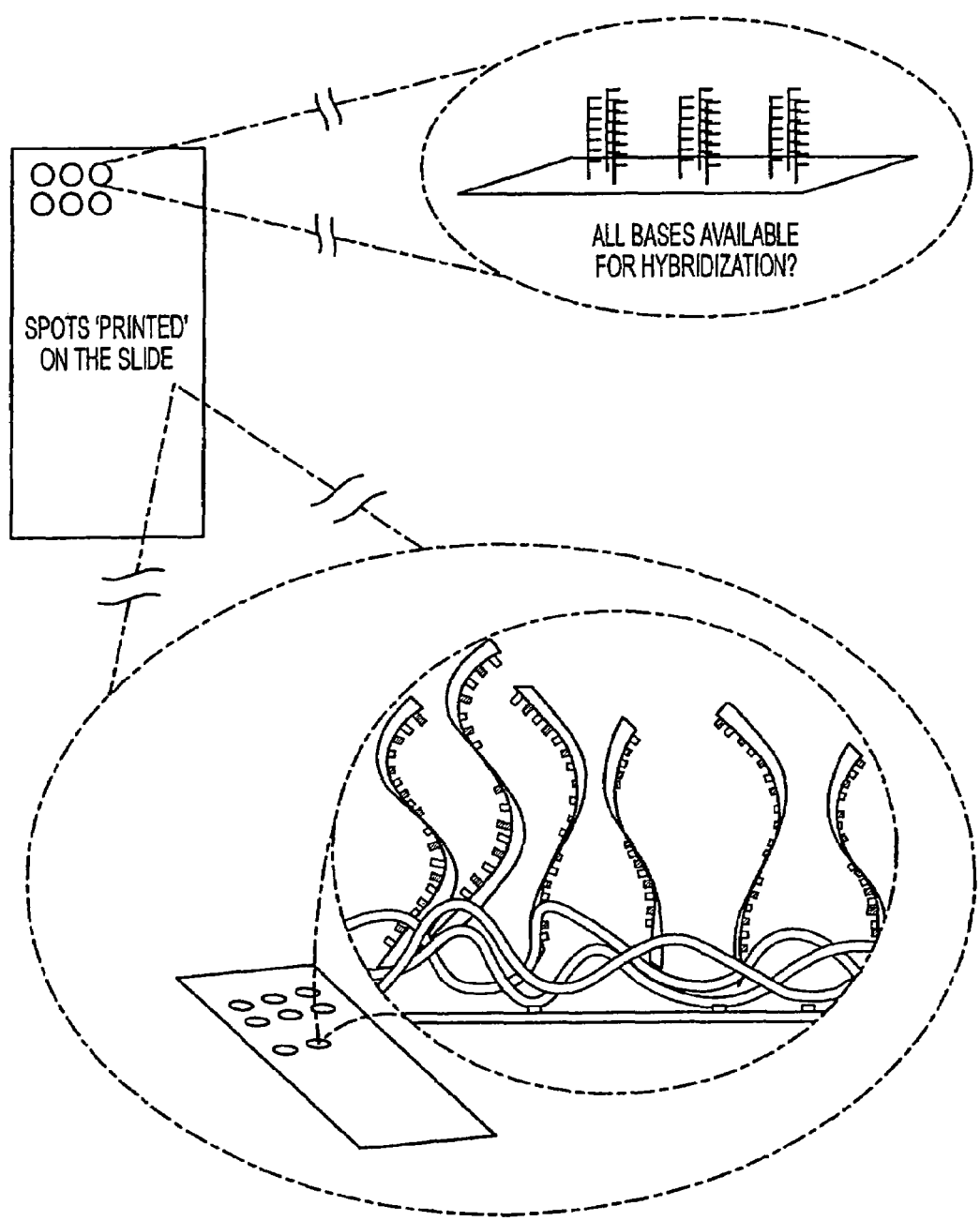
FIG. 4 is schematic presentation of the oligonucleotide based microarray fabrication.
Figure 5:
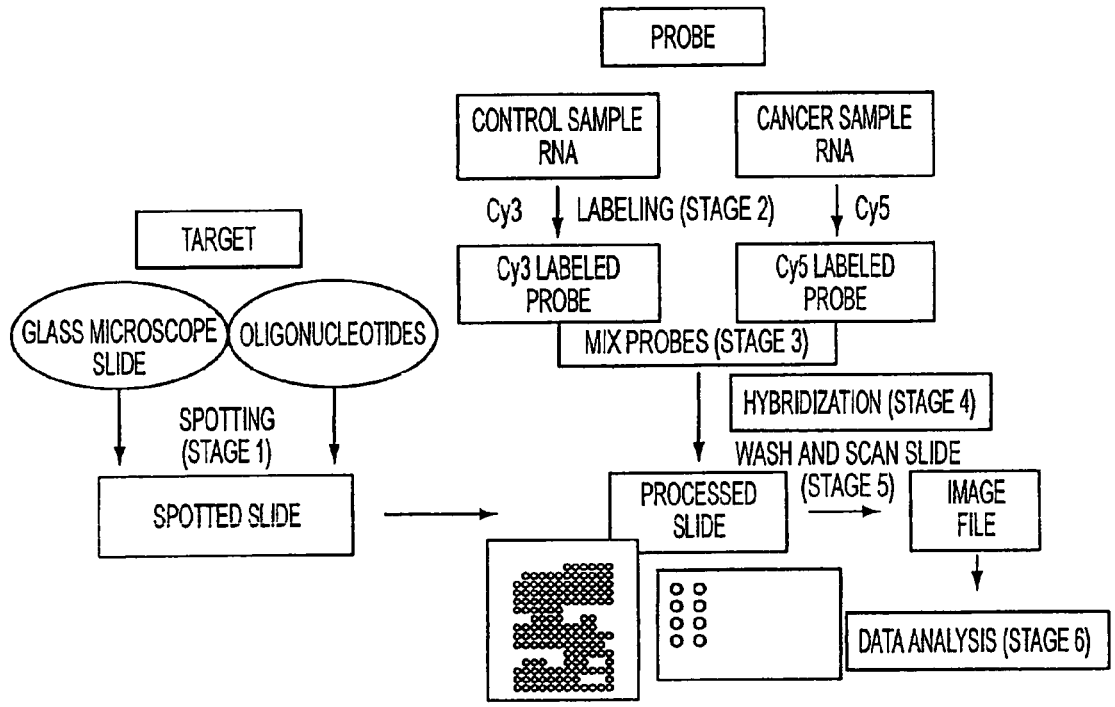
FIG. 5 is schematic summary of the oligonucleotide based microarray experimental flow.

Schematic summary of the oligonucleotide based microarray fabrication and the experimental flow is presented in FIGS. 4 and 5.

Briefly, as shown in FIG. 4, DNA oligonucleotides at 25 uM were deposited (printed) onto Amersham 'CodeLink' glass slides generating a well defined 'spot'. These slides are covered with a long-chain, hydrophilic polymer chemistry that creates an active 3-D surface that covalently binds the DNA oligonucleotides 5'-end via the C6-amine modification.

This binding ensures that the full length of the DNA oligonucleotides is available for hybridization to the cDNA and also allows lower background, high sensitivity and reproducibility.

FIG. 5 shows a schematic method for performing the microarray experiments. It should be noted that stages on the left-hand or right-hand side may optionally be performed in any order, including in parallel, until stage 4 (hybridization). Briefly, on the left-hand side, the target oligonucleotides are being spotted on a glass microscope slide (although optionally other materials could be used) to form a spotted slide (stage 1). On the right hand side, control sample RNA and cancer sample RNA are Cy3 and Cy5 labeled, respectively (stage 2), to form labeled probes. It should be noted that the control and cancer samples come from corresponding tissues (for example, normal prostate tissue and cancerous prostate tissue). Furthermore, the tissue from which the RNA was taken is indicated below in the specific examples of data for particular clusters, with regard to overexpression of an oligonucleotide from a "chip" (microarray), as for example "prostate" for chips in which prostate cancerous tissue and normal tissue were tested as described above. In stage 3, the probes are mixed. In stage 4, hybridization is performed to form a processed slide. In stage 5, the slide is washed and scanned to form an image file, followed by data analysis in stage 6.

Description for Cluster T10888

Cluster T10888 features 4 transcript(s) and 8 segment(s) of interest, the names for which are given in Tables 1 and 2, respectively, the sequences themselves are given at the end of the application. The selected protein variants are given in table 3. TABLE-US-00092 TABLE 1 Transcripts of interest Transcript Name Sequence ID No. T10888_PEA_1_T1 1 T10888_PEA_1_T4 2 T10888_PEA_1_T5 3 T10888_PEA_1_T6 4

TABLE-US-00093 TABLE 2 Segments of interest Segment Name Sequence ID No. T10888_PEA_1_node_11 5 T10888_PEA_1_node_12 6 T10888_PEA_1_node_17 7 T10888_PEA_1_node_4 8 T10888_PEA_1_node_6 9 T10888_PEA_1_node_7 10 T10888_PEA_1_node_9 11 T10888_PEA_1_node_15 12

TABLE-US-00094 TABLE 3 Proteins of interest Protein Name Sequence ID No. T10888_PEA_1_P2 14 T10888_PEA_1_P4 15 T10888_PEA_1_P5 16 T10888_PEA_1_P6 17

These sequences are variants of the known protein Carcinoembryonic antigen-related cell adhesion molecule 6 precursor (SEQ ID NO:13) (SwissProt accession identifier CEA6_HUMAN; known also according to the synonyms Normal cross-reacting antigen; Nonspecific crossreacting antigen; CD66c antigen), SEQ ID NO:13, referred to herein as the previously known protein.

The sequence for protein Carcinoembryonic antigen-related cell adhesion molecule 6 precursor (SEQ ID NO: 13) is given at the end of the application, as "Carcinoembryonic antigen-related cell adhesion molecule 6 precursor (SEQ ID NO:13) amino acid sequence". Known polymorphisms for this sequence are as shown in Table 4. TABLE-US-00095 TABLE 4 Amino acid mutations for Known Protein SNP position(s) on amino acid sequence Comment 138 F→L 239 V→G Protein Carcinoembryonic antigen-related cell adhesion molecule 6 precursor (SEQ ID NO:13) localization is believed to be Attached to the membrane by a GPI-anchor.

The previously known protein also has the following indication(s) and/or potential therapeutic use(s): Cancer. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Immunostimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Imaging agent; Anticancer; Immunostimulant; Immunoconjugate; Monoclonal antibody, murine; Antisense therapy; antibody.

The following GO Annotation(s) apply to the previously known protein. The following annotation(s) were found: signal transduction; cell-cell signaling, which are annotation(s) related to Biological Process; and integral plasma membrane protein, which are annotation(s) related to Cellular Component.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster T10888 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 6 refer to weighted expression of ESTs in each category, as "parts per million" (ratio of the expression of ESTs for a particular cluster to the expression of all ESTs in that category, according to parts per million).

Figure 6:
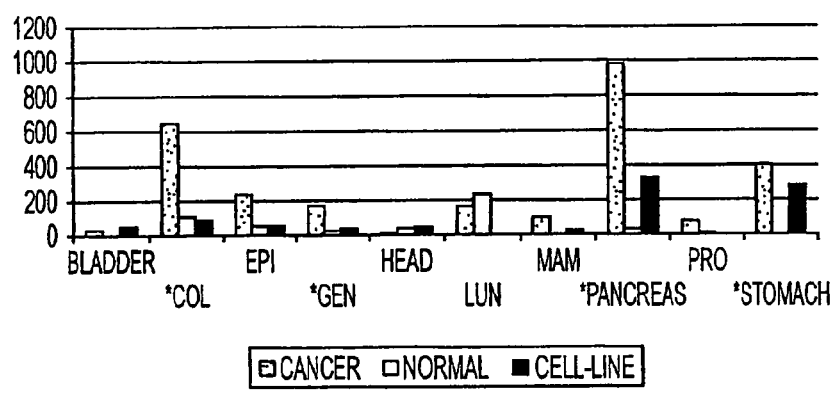
FIG. 6 is a histogram showing Cancer and cell-line vs. normal tissue expression for Cluster T10888, demonstrating overexpression in colorectal cancer, a mixture of malignant tumors from different tissues, pancreas carcinoma and gastric carcinoma.

Overall, the following results were obtained as shown with regard to the histograms in FIG. 6 and Table 5. This cluster is overexpressed (at least at a minimum level) in the following pathological conditions: colorectal cancer, a mixture of malignant tumors from different tissues, pancreas carcinoma and gastric carcinoma. TABLE-US-00096 TABLE 5 Normal tissue distribution Name of Tissue Number Bladder 0 Colon 107 Epithelial 52 General 22 head and neck 40 Lung 237 Breast 0 pancreas 32 Prostate 12 Stomach 0

TABLE-US-00097 TABLE 6 P values and ratios for expression in cancerous tissue Name of Tissue P1 P2 SP1 R3 SP2 R4 Bladder 5.4e-01 3.4e-01 5.6e-01 1.8 4.6e-01 1.9 Colon 1.2e-01 1.7e-01 2.8e-05 3.7 7.9e-04 2.8 epithelial 3.3e-02 2.1e-01 2.8e-20 2.8 4.8e-10 1.9 General 3.3e-05 2.2e-03 1.9e-44 4.9 4.6e-27 3.3 head and neck 4.6e-01 4.3e-01 1 0.8 7.5e-01 1.0 Lung 7.6e-01 8.2e-01 8.9e-01 0.6 1 0.3 Breast 3.7e-02 4.1e-02 1.5e-01 3.3 3.1e-01 2.4 pancreas 2.6e-01 2.4e-01 8.6e-23 2.8 1.5e-19 4.5 Prostate 9.1e-01 9.3e-01 4.1e-02 1.2 1.0e-01 1.0 Stomach 4.5e-02 5.6e-02 5.1e-04 4.1 4.7e-04 6.3

As noted above, cluster T10888 features 4 transcript(s), which were listed in Table 1 above. These transcript(s) encode for protein(s) which are variant(s) of protein Carcinoembryonic antigen-related cell adhesion molecule 6 precursor (SEQ ID NO:13). A description of each variant protein according to the present invention is now provided.

Variant protein T10888_PEA.sub.--1_P2 (SEQ ID NO:14) according to the present invention has an amino acid sequence as given at the end of the application; it is encoded by transcript(s) T10888_PEA.sub.--1_T1 (SEQ ID NO:1). An alignment is given to the known protein (Carcinoembryonic antigen-related cell adhesion molecule 6 precursor (SEQ ID NO:13)) at the end of the application. One or more alignments to one or more previously published protein sequences are given at the end of the application. A brief description of the relationship of the variant protein according to the present invention to each such aligned protein is as follows:

Comparison report between T10888_PEA.sub.--1_P2 (SEQ ID NO:14) and CEA6_HUMAN (SEQ ID NO:13):

1. An isolated chimeric polypeptide encoding for T10888_PEA.sub.--1_P2 (SEQ ID NO:14), comprising a first amino acid sequence being at least 90% homologous to MGPPSAPPCRLHVPWKEVLLTASLLTF-WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVYPELP-KPSISSNNSNPVEDKDAVAFTCEPEVQNTTYL WWVNGQSLPVSPRLQLSNGNMTLTLLS-VKRNDAGSYECEIQNPASANRSDPVTLNVLY GPDVP-TISPSKANYRPGENLNLSCHAASNP-PAQYSWFINGTFQQSTQELFIPNITVNNSGS YMCQAHNSATGLNRTTVTMITVS corresponding to amino acids 1-319 of CEA6_HUMAN (SEQ ID NO:13), which also corresponds to amino acids 1-319 of T10888_PEA.sub.--1_P2 (SEQ ID NO:14), and a second amino acid sequence being at least 70%, optionally at least 80%, preferably at least 85%, more preferably at least 90% and most preferably at least 95% homologous to a polypeptide having the sequence DWTRP (SEQ ID NO:999) corresponding to amino acids 320-324 of T10888_PEA.sub.--1_P2 (SEQ ID NO:14), wherein said first and second amino acid sequences are contiguous and in a sequential order.

2. An isolated polypeptide encoding for a tail of T10888_PEA.sub.--1_P2 (SEQ ID NO:14), comprising a polypeptide being at least 70%, optionally at least about 80%, preferably at least about 85%, more preferably at least about 90% and most preferably at least about 95% homologous to the sequence DWTRP (SEQ ID NO:999) in T10888_PEA.sub.--1_P2 (SEQ ID NO:14).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T10888_PEA.sub.--1_P2 (SEQ ID NO:14) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein T10888_PEA.sub.--1_P2 (SEQ ID NO:14) sequence provides support for the deduced sequence of this variant protein according to the present invention). TABLE-US-00098 TABLE 7 Amino acid mutations SNP position(s) on amino acid Alternative sequence amino acid(s) Previously known SNP? 13 V→No 232 N→D No 324 P→No 63 I→No 92 G→No Variant protein T10888_PEA.sub.--1_P2 (SEQ ID NO:14) is encoded by the following transcript(s): T10888_PEA.sub.--1_T1 (SEQ ID NO:1), for which the sequence(s) is/are given at the end of the application. The coding portion of transcript T10888_PEA.sub.--1_T1 (SEQ ID NO:1) is shown in bold; this coding portion starts at position 151 and ends at position 1122. The transcript also has the following SNPs as listed in Table 8 (given according to their position on the nucleotide sequence, with the alternative nucleic acid listed; the last column indicates whether the SNP is known or not; the presence of known SNPs in variant protein T10888_PEA.sub.--1.sub.--P2 (SEQ ID NO:14) sequence provides support for the deduced sequence of this variant protein according to the present invention). TABLE-US-00099 TABLE 8 Nucleic acid SNPs SNP position on Alternative Previously nucleotide sequence nucleic acid known SNP? 119 C→T No 120 A→T No 1062 A→G Yes 1120 C→No 1297 G→T Yes 1501 A→G Yes 1824 G→A No 2036 A→C No 2036 A→G No 2095 A→C No 2242 A→C No 2245 A→C No 189 C→No 2250 A→T Yes 2339 C→A Yes 276 G→A Yes 338 T→No 424 G→No 546 A→G No 702 C→T No 844 A→G No 930 C→T Yes Variant protein T10888_PEA.sub.--1_P4 (SEQ ID NO:15) according to the present invention has an amino acid sequence as given at the end of the application; it is encoded by transcript(s) T10888_PEA.sub.--1_T4 (SEQ ID NO:2). An alignment is given to the known protein (Carcinoembryonic antigen-related cell adhesion molecule 6 precursor (SEQ ID NO:13)) at the end of the application. One or more alignments to one or more previously published protein sequences are given at the end of the application. A brief description of the relationship of the variant protein according to the present invention to each such aligned protein is as follows:

Comparison report between T10888_PEA.sub.--1_P4 (SEQ ID NO:15) and CEA6_HUMAN SEQ ID NO:13):

1. An isolated chimeric polypeptide encoding for T10888_PEA.sub.--1_P4 (SEQ ID NO:15), comprising a first amino acid sequence being at least 90% homologous to TABLE-US-00100 MGPPSAPPCRLHVPWKEVLL-TASLLTFWNPPTTAKLTIESTPFNVAEGKEVLLLAH NLPQNRIGYSWYKGERVDGNSLIVGYVIGTQQA TPGPAYSGRETIYPNASLLIQNVTQNDT-GFYTLQVIKSDLVNEEATGQFHVYPELPKPSISSNNS NPVEDKDAVAFTCEPEVQNTTYLWWVNGQSLPVS PRLQLSNGNMTLTLLSVKRNDAGSYECEIQNP ASANRSDPVTLNVL corresponding to amino acids 1-234 of CEA6_HUMAN (SEQ ID NO:13), which also corresponds to amino acids 1-234 of T10888_PEA.sub.--1_P4 (SEQ ID NO:15), and a second amino acid sequence being at least 70%, optionally at least 80%, preferably at least 85%, more preferably at least 90% and most preferably at least 95% homologous to a polypeptide having the sequence LLLSSQLWPPSASRLECWPGWL (SEQ ID NO:1000) corresponding to amino acids 235-256 of T10888_PEA.sub.--1_P4 (SEQ ID NO:15), wherein said first and second amino acid sequences are contiguous and in a sequential order.

2. An isolated polypeptide encoding for a tail of T10888_PEA.sub.--1_P4 (SEQ ID NO:15), comprising a polypeptide being at least 70%, optionally at least about 80%, preferably at least about 85%, more preferably at least about 90% and most preferably at least about 95% homologous to the sequence LLLSSQLWPPSASRLECWPGWL (SEQ ID NO:1000) in T10888_PEA.sub.--1_P4 (SEQ ID NO:15).

Comparison report between T10888_PEA.sub.--1_P4 (SEQ ID NO:15) and Q13774 (SEQ ID NO:829):

1. An isolated chimeric polypeptide encoding for T10888_PEA.sub.--1_P4 (SEQ ID NO:15), comprising a first amino acid sequence being at least 90% homologous to MGPPSAPPCRLHVPWKEVLLTASLLTF-WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVYPELP-KPSISSNNSNPVEDKDAVAFTCEPEVQNTTYL WWVNGQSLPVSPRLQLSNGNMTLTLLS-VKRNDAGSYECEIQNPASANRSDPVTLNVL corresponding to amino acids 1-234 of Q13774, which also corresponds to amino acids 1-234 of T10888_PEA.sub.--1_P4 (SEQ ID NO:15), and a second amino acid sequence being at least 70%, optionally at least 80%, preferably at least 85%, more preferably at least 90% and most preferably at least 95% homologous to a polypeptide having the sequence LLLSSQLWPPSASRLECWPGWL (SEQ ID NO:1000) corresponding to amino acids 235-256 of T10888_PEA.sub.--1_P4 (SEQ ID NO:15), wherein said first and second amino acid sequences are contiguous and in a sequential order.

2. An isolated polypeptide encoding for a tail of T10888_PEA.sub.--1_P4 (SEQ ID NO:15), comprising a polypeptide being at least 70%, optionally at least about 80%, preferably at least about 85%, more preferably at least about 90% and most preferably at least about 95% homologous to the sequence LLLSSQLWPPSASRLECWPGWL (SEQ ID NO:1000) in T10888_PEA.sub.--1_P4 (SEQ ID NO:15).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T10888_PEA.sub.--1_P4 (SEQ ID NO:15 also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein T10888_PEA.sub.--1_P4 (SEQ ID NO:15) sequence provides support for the deduced sequence of this variant protein according to the present invention). TABLE-US-00101 TABLE 9 Amino acid mutations SNP position(s) on amino acid Alternative sequence amino acid(s) Previously known SNP? 13 V→No 232 N→D No 63 I→No 92 G→No Variant protein T10888_PEA.sub.--1_P4 (SEQ ID NO:15) is encoded by the following transcript(s): T10888_PEA.sub.--1_T4 (SEQ ID NO:2), for which the sequence(s) is/are given at the end of the application. The coding portion of transcript T10888_PEA.sub.--1_T4 (SEQ ID NO:2) is shown in bold; this coding portion starts at position 151 and ends at position 918. The transcript also has the following SNPs as listed in Table 10 (given according to their position on the nucleotide sequence, with the alternative nucleic acid listed; the last column indicates whether the SNP is known or not; the presence of known SNPs in variant protein T10888_PEA.sub.--1_P4 SEQ ID NO: 15) sequence provides support for the deduced sequence of this variant protein according to the present invention). TABLE-US-00102 TABLE 10 Nucleic acid SNPs SNP position on Alternative Previously nucleotide sequence nucleic acid known SNP? 119 C→T No 120 A→T No 978 C→No 1155 G→T Yes 1359 A→G Yes 1682 G→A No 1894 A→C No 1894 A→G No 1953 A→C No 2100 A→C No 2103 A→C No 2108 A→T Yes 189 C→No 2197 C→A Yes 276 G→A Yes 338 T→No 424 G→No 546 A→G No 702 C→T No 844 A→G No 958 G→No Variant protein T10888_PEA.sub.--1_P5 (SEQ ID NO:16) according to the present invention has an amino acid sequence as given at the end of the application; it is encoded by transcript(s) T10888_PEA.sub.--1_T5 (SEQ ID NO:3). An alignment is given to the known protein (Carcinoembryonic antigen-related cell adhesion molecule 6 precursor (SEQ ID NO:13)) at the end of the application. One or more alignments to one or more previously published protein sequences are given at the end of the application. A brief description of the relationship of the variant protein according to the present invention to each such aligned protein is as follows:

Comparison report between T10888_PEA.sub.--1_P5 (SEQ ID NO:16) and CEA6_HUMAN (SEQ ID NO:13):

1. An isolated chimeric polypeptide encoding for T10888_PEA.sub.--1_P5 (SEQ ID NO:16), comprising a first amino acid sequence being at least 90% homologous to MGPPSAPPCRLHVPWKEVLLTASLLTF-WNPPTTAKLTIESTPFNVAEGKEVLLLAHNLP QNRI-GYSWYKGERVDGNSLIVGYVIGTQQAT-PGPAYSGRETIYPNASLLIQNVTQNDTG FYTLQVIKSDLVNEEATGQFHVYPELP-KPSISSNNSNPVEDKDAVAFTCEPEVQNTTYL WWVNGQSLPVSPRLQLSNGNMTLTLLS-VKRNDAGSYECEIQNPASANRSDPVTLNVLY GPDVP-TISPSKANYRPGENLNLSCHAASNP-PAQYSWFINGTFQQSTQELFIPNITVNNSGS YMCQAHNSATGLNRTTVTMITVSG corresponding to amino acids 1-320 of CEA6_HUMAN (SEQ ID NO:13), which also corresponds to amino acids 1-320 of T10888_PEA.sub.--1_P5 (SEQ ID NO:16), and a second amino acid sequence being at least 70%, optionally at least 80%, preferably at least 85%, more preferably at least 90% and most preferably at least 95% homologous to a polypeptide having the sequence KWIHEALASHFQVESGSQR-RARKKFSFPTCVQGAHANPKFSPEP-SQFTSADSFPLVFLFF VVFCFLISHV (SEQ ID NO:1001) corresponding to amino acids 321-390 of T10888_PEA.sub.--1_P5 (SEQ ID NO:16), wherein said first and second amino acid sequences are contiguous and in a sequential order.

2. An isolated polypeptide encoding for a tail of T10888_PEA.sub.--1_P5 (SEQ ID NO:16), comprising a polypeptide being at least 70%, optionally at least about 80%, preferably at least about 85%, more preferably at least about 90% and most preferably at least about 95% homologous to the sequence TABLE-US-00103 KWIHEALASHFQVESG-SQRRARKKFSFPTCVQGAHANPKFSPEP-SQFTSADSFPLVFLFF (SEQ ID NO: 1001) WFCFLISHV in T10888_PEA_1_P5. (SEQ ID NO: 16)

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein T10888_PEA.sub.--1_P5 (SEQ ID NO:16) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein T10888_PEA.sub.--1_P5 (SEQ ID NO:16) sequence provides support for the deduced sequence of this variant protein according to the present invention). TABLE-US-00104 TABLE 11 Amino acid mutations SNP position(s) on amino acid Alternative sequence amino acid(s) Previously known SNP? 13 V→No 232 N→D No 63 I→No 92 G→No Variant protein T10888_PEA.sub.--1_P5 (SEQ ID NO 16) is encoded by the following transcript(s):

T10888_PEA.sub.--1_T5 (SEQ ID NO:3), for which the sequence(s) is/are given at the end of the application. The coding portion of transcript T10888_PEA.sub.--1_T5 (SEQ ID NO:3) is shown in bold; this coding portion starts at position 151 and ends at position 1320. The transcript also has the following SNPs as listed in Table 12 (given according to their position on the nucleotide sequence, with the alternative nucleic acid listed; the last column indicates whether the SNP is known or not; the presence of known SNPs in variant protein T10888_PEA.sub.--1_P5 (SEQ ID NO:16) sequence provides support for the deduced sequence of variant protein according to the present invention). TABLE-US-00105 TABLE 12 Nucleic acid SNPs SNP position on Alternative Previously nucleotide sequence nucleic acid known SNP? 119 C→T No 120 A→T No 1062 A→G Yes 1943 C→A Yes 2609 C→T Yes 2647 C→G No 2701 C→T Yes 2841 T→C Yes 189 C→No 276 G→A Yes 338 T→No 424 G→No 546 A→G No 702 C→T No 844 A→G No 930 C→T Yes Variant protein T10888_PEA.sub.--1_P6 (SEQ ID NO:17) according to the present invention has an amino acid sequence as given at the end of the application; it is encoded by transcript(s) T10888_PEA.sub.--1_T6 (SEQ ID NO:4). An alignment is given to the known protein (Carcinoembryonic antigen-related cell adhesion molecule 6 precursor (SEQ ID NO:13)) at the end of the application. One or more alignments to one or more previously published protein sequences are given at the end of the application.

Comparison report between T10888_PEA.sub.--1P6 (SEQ ID NO:17) and CEA6_HUMAN (SEQ ID NO:13):

1. An isolated chimeric polypeptide encoding for T10888_PEA.sub.--1_P6 (SEQ ID NO:17), comprising a first amino acid sequence being at least 90% homologous to TABLE-US-00106 MGPPSAPPCRLHVPWKEVLL-TASLLTFWNPPTTAKLTIESTPFNVAEGKEVLLLA HNLPQNRIGYSW-YKGERVDGNSLIVGYVIGTQQATPGPAY-SGRETIYPNASLLIQNVTQ NDTGFYTLQVIKS-DLVNEEATGQFHVY corresponding to amino acids 1-141 of CEA6_HUMAN (SEQ ID NO:13), which also corresponds to amino acids 1-141 of T10888_PEA.sub.--1P6 (SEQ ID NO:17), and a second amino acid sequence being at least 70%, optionally at least 80%, preferably at least 85%, more preferably at least 90% and most preferably at least 95% homologous to a polypeptide having the sequence TABLE-US-00107 (SEQ ID NO: 1002) REYFHMTSGCWGSVLLPTYGIVR-PGLCLWPSLHYILYQGLDI corresponding to amino acids 142-183 of T10888_PEA.sub.--1_P6 (SEQ ID NO:17), wherein said first and second amino acid sequences are contiguous and in a sequential order.

2. An isolated polypeptide encoding for a tail of T10888_PEA.sub.--1_P6 (SEQ ID NO:17), comprising a polypeptide being at least 70%, optionally at least about 80%, preferably at least about 85%, more preferably at least about 90% and most preferably at least about 95% homologous to the sequence TABLE-US-00108 (SEQ ID NO: 1002) REYFHMTSGCWGSVLLPTYGIVR-PGLCLWPSLHYILYQGLDI (SEQ ID NO: 17) in T10888_PEA_1_P6.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T10888_PEA.sub.--1_P6 (SEQ ID NO:17) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein T10888_PEA.sub.--1_P6 (SEQ ID NO:17) sequence provides support for the deduced sequence of this variant protein according to the present invention). TABLE-US-00109 TABLE 13 Amino acid mutations SNP position(s) on amino acid Alternative sequence amino acid(s) Previously known SNP? 13 V→No 63 I→No 92 G→No Variant protein T10888_PEA.sub.--1_P6 (SEQ ID NO:17) is encoded by the following transcript(s): T10888_PEA.sub.--1_T6 (SEQ ID NO:4), for which the sequence(s) is/are given at the end of the application. The coding portion of transcript T10888_PEA.sub.--1_T6 (SEQ ID NO:4) is shown in bold; this coding portion starts at position 151 and ends at position 699. The transcript also as the following SNPs as listed in Table 14 (given according to their position on the nucleotide sequence, with the alternative nucleic acid listed; the last column indicates whether the SNP is known or not; the presence of known SNPs in variant protein T10888_PEA.sub.--1_P6 (SEQ ID NO:17) sequence provides support for the deduced sequence of this variant protein according to the present invention). TABLE-US-00110 TABLE 14 Nucleic acid SNPs SNP position on Alternative Previously nucleotide sequence nucleic acid known SNP? 119 C→T No 120 A→T No 189 C→No 276 G→A Yes 338 T→No 424 G→No 546 A→G No As noted above, cluster T10888 features 8 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T10888_PEA.sub.--1_node.sub.--11 (SEQ ID NO:5) according to the present invention is supported by 57 libraries. The number of libraries was determined as previously described. This segment can be found in the following transcript(s): T10888_PEA.sub.--1_T1 (SEQ ID NO:1) and T10888_PEA.sub.--1_T5 (SEQ ID NO:3). Table 15 below describes the starting and ending position of this segment on each transcript. TABLE-US-00111 TABLE 15 Segment location on transcripts Segment Segment Transcript name starting position ending position T10888_PEA__1_T1 (SEQ ID 854 1108 NO: 1) T10888_PEA__1_T5 (SEQ ID 854 1108 NO: 3)

Segment cluster T10888_PEA.sub.--1_node.sub.--12 (SEQ ID NO:6) according to the present invention is supported by 9 libraries. The number of libraries was determined as previously described. This segment can be found in the following transcript(s): T10888_PEA.sub.--1_T5 (SEQ ID NO:3). Table 16 below describes the starting and ending position of this segment on each transcript. TABLE-US-00112 TABLE 16 Segment location on transcripts Segment Segment Transcript name starting position ending position T10888_PEA__1_T5 (SEQ ID 1109 3004 NO: 3)

Segment cluster T10888_PEA.sub.--1_node.sub.--17 (SEQ ID NO:7) according to the present invention is supported by 160 libraries. The number of libraries was determined as previously described. This segment can be found in the following transcript(s): T10888_PEA.sub.--1_T1 (SEQ ID NO:1) and T10888_PEA.sub.--1_T4 (SEQ ID NO:2). Table 17 below describes the starting and ending position of this segment on each transcript. TABLE-US-00113 TABLE 17 Segment location on transcripts Segment Segment Transcript name starting position ending position T10888_PEA__1_T1 (SEQ ID 1109 2518 NO: 1) T10888_PEA__1_T4 (SEQ ID 967 2376 NO: 2)

Segment cluster T10888_PEA.sub.--1_node.sub.--4 (SEQ ID NO:8) according to the present invention is supported by 61 libraries. The number of libraries was determined as previously described. This segment can be found in the following transcript(s): T10888_PEA.sub.--1_T1 (SEQ ID NO:1), T10888_PEA.sub.--1_T4 (SEQ ID NO:2), T10888_PEA.sub.--1_T5 (SEQ ID NO:3) and T10888_PEA.sub.--1_T6 (SEQ ID NO:4). Table 18 below describes the starting and ending position of this segment on each transcript. TABLE-US-00114 TABLE 18 Segment location on transcripts Segment Segment Transcript name starting position ending position T10888_PEA__1_T1 (SEQ ID 1 214 NO: 1) T10888_PEA__1_T4 (SEQ ID 1 214 NO: 2) T10888_PEA__1_T5 (SEQ ID 1 214 NO: 3) T10888_PEA__1_T6 (SEQ ID 1 214 NO: 4)

Segment cluster T10888_PEA.sub.--1_node.sub.--6 (SEQ ID NO:9) according to the present invention is supported by 81 libraries. The number of libraries was determined as previously described. This segment can be found in the following transcript(s): T10888_PEA.sub.--1_T1 (SEQ ID NO:1), T10888_PEA.sub.--1_T4 (SEQ ID NO:2), T10888_PEA.sub.--1_T5 (SEQ ID NO:3) and T10888_PEA.sub.--1_T6 (SEQ ID NO:4). Table 19 below describes the starting and ending position of this segment on each transcript. TABLE-US-00115 TABLE 19 Segment location on transcripts Segment Segment Transcript name starting position ending position T10888_PEA__1_T1 (SEQ ID 215 574 NO: 1) T10888_PEA__1_T4 (SEQ ID 215 574 NO: 2) T10888_PEA__1_T5 (SEQ ID 215 574 NO: 3) T10888_PEA__1_T6 (SEQ ID 215 574 NO: 4)

Segment cluster T10888_PEA.sub.--1_node.sub.--7 (SEQ ID NO:10) according to the present invention is supported by 4 libraries. The number of libraries was determined as previously described. This segment can be found in the following transcript(s): T10888_PEA.sub.--1_T6 (SEQ ID NO:4). Table 20 below describes the starting and ending position of this segment on each transcript. TABLE-US-00116 TABLE 20 Segment location on transcripts Segment Segment Transcript name starting position ending position T10888_PEA__1_T6 (SEQ ID 575 1410 NO: 4)

Segment cluster T10888_PEA.sub.--1_node.sub.--9 (SEQ ID NO:11) according to the present invention is supported by 72 libraries. The number of libraries was determined as previously described. This segment can be found in the following transcript(s): T10888_PEA.sub.--1_T1 (SEQ ID NO:1), T10888_PEA.sub.--1_T4 (SEQ ID NO:2) and T10888_PEA.sub.--1_T5 (SEQ ID NO:3). Table 21 below describes the starting and ending position of this segment on each transcript. TABLE-US-00117 TABLE 21 Segment location on transcripts Segment Segment Transcript name starting position ending position T10888_PEA__1_T1 (SEQ ID 575 853 NO: 1) T10888_PEA__1_T4 (SEQ ID 575 853 NO: 2) T10888_PEA__1_T5 (SEQ ID 575 853 NO: 3)

According to an optional embodiment of the present invention, short segments related to the above cluster are also provided. These segments are up to about 120 bp in length, and so are included in a separate description.

Segment cluster T10888_PEA.sub.--1_node.sub.--15 (SEQ ID NO:12) according to the present invention is supported by 39 libraries. The number of libraries was determined as previously described. This segment can be found in the following transcript(s): T10888_PEA.sub.--1_T4 (SEQ ID NO:2). Table 22 below describes the starting and ending position of this segment on each transcript. TABLE-US-00118 TABLE 22 Segment location on transcripts Segment Segment Transcript name starting position ending position T10888_PEA__1T4 (SEQ ID 854 966 NO: 2)

Variant protein alignment to the previously known protein:

Sequence name: /tmp/tM4EgaoKvm/vuztUrlRc7:CEA6_HUMAN (SEQ ID NO:13).

Sequence documentation:

Alignment of: T10888_PEA.sub.--1_P2 (SEQ ID NO:14).times.CEA6_HUMAN (SEQ ID NO:13)

Alignment segment 1/1: TABLE-US-00119 Quality: 3163.00 Escore: 0 Matching length: 319 Total length: 319 Matching Percent 100.00 Matching Percent Identity: 100.00 Similarity: Total Percent Similarity: 100.00 Total Percent Identity: 100.00 Gaps: 0

```
Alignment: TABLE-US-00120 1
MGPPSAPPCRLHVPWKEVLLTASLLTFWNPPTTAKLTIESTPFNVAEGKE  50
||||||||||||||||||||||||||||||||||||||||||||||||||  1
MGPPSAPPCRLHVPWKEVLLTASLLTFWNPPTTAKLTIESTPFNVAEGKE  50 . . . 51

VLLLAHNLPQNRIGYSWYKGERVDGNSLIVGYVIGTQQATPGPAYSGRET  100
||||||||||||||||||||||||||||||||||||||||||||||||||  51
VLLLAHNLPQNRIGYSWYKGERVDGNSLIVGYVIGTQQATPGPAYSGRET  100 . . . 101

IYPNASLLIQNVTQNDTGFYTLQVIKSDLVNEEATGQFHVYPELPKPSIS  150
||||||||||||||||||||||||||||||||||||||||||||||||||  101
IYPNASLLIQNVTQNDTGFYTLQVIKSDLVNEEATGQFHVYPELPKPSIS  150 151

SNNSNPVEDKDAVAFTCEPEVQNTTYLWWVNGQSLPVSPRLQLSNGNMTL  200
||||||||||||||||||||||||||||||||||||||||||||||||||  151
SNNSNPVEDKDAVAFTCEPEVQNTTYLWWVNGQSLPVSPRLQLSNGNMTL  200 . . . 201

TLLSVKRNDAGSYECEIQNPASANRSDPVTLNVLYGPDVPTISPSKANYR  250
||||||||||||||||||||||||||||||||||||||||||||||||||  201
TLLSVKRNDAGSYECEIQNPASANRSDPVTLNVLYGPDVPTISPSKANYR  250 . . . 251

PGENLNLSCHAASNPPAQYSWFINGTFQQSTQELFIPNITVNNSGSYMCQ  300
||||||||||||||||||||||||||||||||||||||||||||||||||  251
PGENLNLSCHAASNPPAQYSWFINGTFQQSTQELFIPNITVNNSGSYMCQ  300 . . . 301
```

```
                                                319
AHNSATGLNRTTVTMITVS
|||||||||||||||||||||||||||||||||||||||       301
AHNSATGLNRTTVTMITVS                             319
```

Sequence name: /tmp/Yjl1gj7TCe/PgdufzLOIW: CEA6_HUMAN (SEQ ID NO:13)

Sequence documentation:

Alignment of: T10888_PEA.sub.--1_P4 (SEQ ID NO:15).times.CEA6_HUMAN (SEQ ID NO: 13).

Alignment segment 1/1: TABLE-US-00121 Quality: 2310.00 Escore: 0 Matching length: 234 Total length: 234 Matching Percent 100.00 Matching Percent Identity: 100.00 Similarity: Total Percent Similarity: 100.00 Total Percent Identity: 100.00 Gaps: 0

Sequence name: /tmp/x5xDBacdpj/rTXRGepv3y: CEA6_HUMAN (SEQ ID NO:13)

Sequence documentation:

Alignment of: T10888_PEA.sub.--1_P5 (SEQ ID NO:16).times.CEA6_HUMAN (SEQ ID NO: 13).

Alignment segment 1/1: TABLE-US-00125 Quality: 3172.00 Escore: 0 Matching length: 320 Total length: 320 Matching Percent 100.00 Matching Percent Identity: 100.00 Similarity: Total Percent Similarity: 100.00 Total Percent Identity: 100.00 Gaps: 0

```
Alignment: TABLE-US-00122 . . . 1
MGPPSAPPCRLHVPWKEVLLTASLLTFWNPPTTAKLTIESTPFNVAEGKE    50
|||||||||||||||||||||||||||||||||||||||||||||||||    1
MGPPSAPPCRLHVPWKEVLLTASLLTFWNPPTTAKLTIESTPFNVAEGKE    50 . . . 51

VLLLAHNLPQNRIGYSWYKGERVDGNSLIVGYVIGTQQATPGPAYSGRET   100
|||||||||||||||||||||||||||||||||||||||||||||||||    51
VLLLAHNLPQNRIGYSWYKGERVDGNSLIVGYVIGTQQATPGPAYSGRET   100 . . . 101

IYPNASLLIQNVTQNDTGFYTLQVIKSDLVNEEATCQFHVYPELPKPSIS   150
|||||||||||||||||||||||||||||||||||||||||||||||||   101
IYPNASLLIQNVTQNDTGFYTLQVIKSDLVNEEATGQFHVYPELPKPSIS   150 . . . 151

SNNSNPVEDKDAVAFTCEPEVQNTTYLWWVNGQSLPVSPRLQLSNGNMTL   200
|||||||||||||||||||||||||||||||||||||||||||||||||   151
SNNSNPVEDKDAVAFTCEPEVQNTTYLWWVNGQSLPVSPRLQLSNGNMTL   200 . . . 201

TLLSVKRNDAGSYECEIQNPASANRSDPVTLNVL                  234
|||||||||||||||||||||||||||||||||                   201
TLLSVKRNDAGSYECEIQNPASANRSDPVTLNVL                  234
```

Sequence name: /tmp/Yjl1gj7TCe/PgdufzLOIW:Q13774

Sequence documentation:

Alignment of: T10888_PEA.sub.--1_P4 (SEQ ID NO:15).times.Q13774.

Alignment segment 1/1: TABLE-US-00123 Quality: 2310.00 Escore: 0 Matching length: 234 Total length: 234 Matching Percent 100.00 Matching Percent Identity: 100.00 Similarity: Total Percent Similarity: 100.00 Total Percent Identity: 100.00 Gaps: 0

```
Alignment: TABLE-US-00124 . . . 1
MGPPSAPPCRLHVPWKEVLLTASLLTFWNPPTTAKLTIESTPFNVAEGKE    50
|||||||||||||||||||||||||||||||||||||||||||||||||    1
MGPPSAPPCRLHVPWKEVLLTASLLTFWNPPTTAKLTIESTPFNVAEGKE    50 . . . 51

VLLLAHNLPQNRIGYSWYKGERVDGNSLIVGYVIGTQQATPGPAYSGRET   100
|||||||||||||||||||||||||||||||||||||||||||||||||    51
VLLLAHNLPQNRIGYSWYKGERVDGNSLIVGYVIGTQQATPGPAYSGRET   100 . . . 101

IYPNASLLIQNVTQNDTGFYTLQVIKSDLVNEEATGQFHVYPELPKPSIS   150
|||||||||||||||||||||||||||||||||||||||||||||||||   101
IYPNASLLIQNVTQNDTGFYTLQVIKSDLVNEEATGQFHVYPELPKPSIS   150 . . . 151

SNNSNPVEDKDAVAFTCEPEVQNTTYLWWVNGQSLPVSPRLQLSNGNMTL   200
|||||||||||||||||||||||||||||||||||||||||||||||||   151
SNNSNPVEDKDAVAFTCEPEVQNTTYLWWVNGQSLPVSPRLQLSNGNMTL   200 . . . 201

TLLSVKRNDAGSYECEIQNPASANRSDPVTLNVL                  234
|||||||||||||||||||||||||||||||||                   201
TLLSVKRNDAGSYECEIQNPASANRSDPVTLNVL                  234
```

```
Alignment: TABLE-US-00126 . . . 1
MGPPSAPPCRLHVPWKEVLLTASLLTFWNPPTTAKLTIESTPFNVAEGKE    50
||||||||||||||||||||||||||||||||||||||||||||||||||
                                                      1
MGPPSAPPCRLHVPWKEVLLTASLLTFWNPPTTAKLTIESTPFNVAEGKE    50 . . . 51

VLLLAHNLPQNRIGYSWYKGERVDGNSLIVGYVIGTQQATPGPAYSGRET    100
||||||||||||||||||||||||||||||||||||||||||||||||||
                                                      51
VLLLAHNLPQNRIGYSWYKGERVDGNSLIVGYVIGTQQATPGPAYSGRET    100 . . . 101

IYPNASLLIQNVTQNDTGFYTLQVIKSDLVNEEATGQFHVYPELPKPSIS    150
||||||||||||||||||||||||||||||||||||||||||||||||||
                                                      101
IYPNASLLIQNVTQNDTGFYTLQVIKSDLVNEEATGQFHVYPELPKPSIS    150 . . . 151

SNNSNPVEDKDAVAFTCEPEVQNTTYLWWVNGQSLPVSPRLQLSNGNMTL    200
||||||||||||||||||||||||||||||||||||||||||||||||||
                                                      151
SNNSNPVEDKDAVAFTCEPEVQNTTYLWWVNGQSLPVSPRLQLSNGNMTL    200 . . . 201

TLLSVKRNDAGSYECEIQNPASANRSDPVTLNVLYGPDVPTISPSKANYR    250
||||||||||||||||||||||||||||||||||||||||||||||||||
                                                      201
TLLSVKRNDAGSYECEIQNPASANRSDPVTLNVLYGPDVPTISPSKANYR    250 . . . 251

PGENLNLSCHAASNPPAQYSWFINGTFQQSTQELFIPNITVNNSGSYMCQ    300
||||||||||||||||||||||||||||||||||||||||||||||||||
                                                      251
PGENLNLSCHAASNPPAQYSWFINGTFQQSTQELFIPNITVNNSGSYMCQ    300 . . . 301

AHNSATGLNRTTVTMITVSG                                 320
||||||||||||||||||||
                                                      301
AHNSATGLNRTTVTMITVSG                                 320
```

Sequence name: /tmp/VAhvYFeatq/QNEM573uCo: CEA6_HUMAN (SEQ ID NO:13)

Sequence documentation:

Alignment of: T10888_PEA.sub.--1_P6 (SEQ ID NO:17).times.CEA6_HUMAN (SEQ ID NO:13).

Alignment segment 1/1: TABLE-US-00127 Quality: 1393.00 Escore: 0 Matching length: 143 Total length: 143 Matching Percent 99.30 Matching Percent Identity: 99.30 Similarity: Total Percent Similarity: 99.30 Total Percent Identity: 99.30 Gaps: 0

Alignment of: T10888_PEA.sub.--1_P6 (SEQ ID NO:17).times.CEA6_HUMAN (SEQ ID NO:13).

Alignment segment 1/1: TABLE-US-00129 Quality: 101.00 Escore: 0 Matching length: 141 Total length: 183 Matching Percent 100.00 Matching Percent Identity: 100.00 Similarity: Total Percent Similarity: 77.05 Total Percent Identity: 77.05 Gaps: 1

```
Alignment: TABLE-US-00128 . . . 1
MGPPSAPPCRLHVPWKEVLLTASLLTFWNPPTTAKLTIESTPFNVAEGKE    50
||||||||||||||||||||||||||||||||||||||||||||||||||
                                                      1
MGPPSAPPCRLHVPWKEVLLTASLLTFWNPPTTAKLTIESTPFNVAEGKE    50 . . . 51

VLLLAHNLPQNRIGYSWYKGERVDGNSLIVGYVIGTQQATPGPAYSGRET    100
||||||||||||||||||||||||||||||||||||||||||||||||||
                                                      51
VLLLAHNLPQNRIGYSWYKGERVDGNSLIVGYVIGTQQATPGPAYSGRET    100 . . . 101

IYPNASLLIQNVTQNDTGFYTLQVIKSDLVNEEATGQFHVYRE          143
||||||||||||||||||||||||||||||||||||||||| |
                                                      101
IYPNASLLIQNVTQNDTGFYTLQVIKSDLVNEEATGQFHVYPE          143
```

```
Alignment: TABLE-US-00130 . . . 1
MGPPSAPPCRLHVPWKEVLLTASLLTFWNPPTTAKLTIESTPFNVAEGKE    50
||||||||||||||||||||||||||||||||||||||||||||||||||
                                                      1
MGPPSAPPCRLHVPWKEVLLTASLLTFWNPPTTAKLTIESTPFNVAEGKE    50 . . . 51

VLLLAHNLPQNRIGYSWYKGERVDGNSLIVGYVIGTQQATPGPAYSGRET    100
||||||||||||||||||||||||||||||||||||||||||||||||||
                                                      51
VLLLAHNLPQNRIGYSWYKGERVDGNSLIVGYVIGTQQATPGPAYSGRET    100 . . . 101

IYPNASLLIQNVTQNDTGFYTLQVIKSDLVNEEATGQFHVYREYFHMTSG   150
||||||||||||||||||||||||||||||||||||||||||
                                                      101
IYPNASLLIQNVTQNDTGFYTLQVIKSDLVNEEATGQFHVY.........   141 . . . 151

CWGSVLLPTYGIVRPGLCLWPSLHYILYQGLDI                    183 141
.................................
                                                      141
```

Expression of CEA6_HUMAN Carcinoembryonic Antigen-Related Cell Adhesion Molecule 6 (T10888) Transcripts which are Detectable by Amplicon as Depicted in Sequence Name T10888 junc11-17 in Normal and Cancerous Breast Tissues Expression of CEA6_HUMAN Carcinoembryonic antigen-related cell adhesion molecule 6 transcripts detectable by or according to junc11-17, T10888junc11-17 (SEQ ID NO:832) amplicon(s) and T10888junc11-17F (SEQ ID NO:830) and T10888junc11-17R primers was measured by real time PCR. In parallel the expression of four housekeeping genes—PBGD (GenBank Accession No. BC019323 (SEQ ID NO:926); amplicon—PBGD-amplicon (SEQ ID NO:929)), HPRT1 (GenBank Accession No. NM.sub.--000194 (SEQ ID NO:930); amplicon—HPRT1-amplicon (SEQ ID NO:933)), and SDHA (GenBank Accession No. NM.sub.--004168 (SEQ ID NO:922Q; amplicon--SDHA-amplicon (SEQ ID NO:925)), G6PD (GenBank Accession No. NM.sub.--000402 (SEQ ID NO:918); G6PD-amplicon (SEQ ID NO:921)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67 Table 1, "Tissue samples in testing panel", above), to obtain a value of fold up-regulation for each sample relative to median of the normal PM samples.

Figure 7:
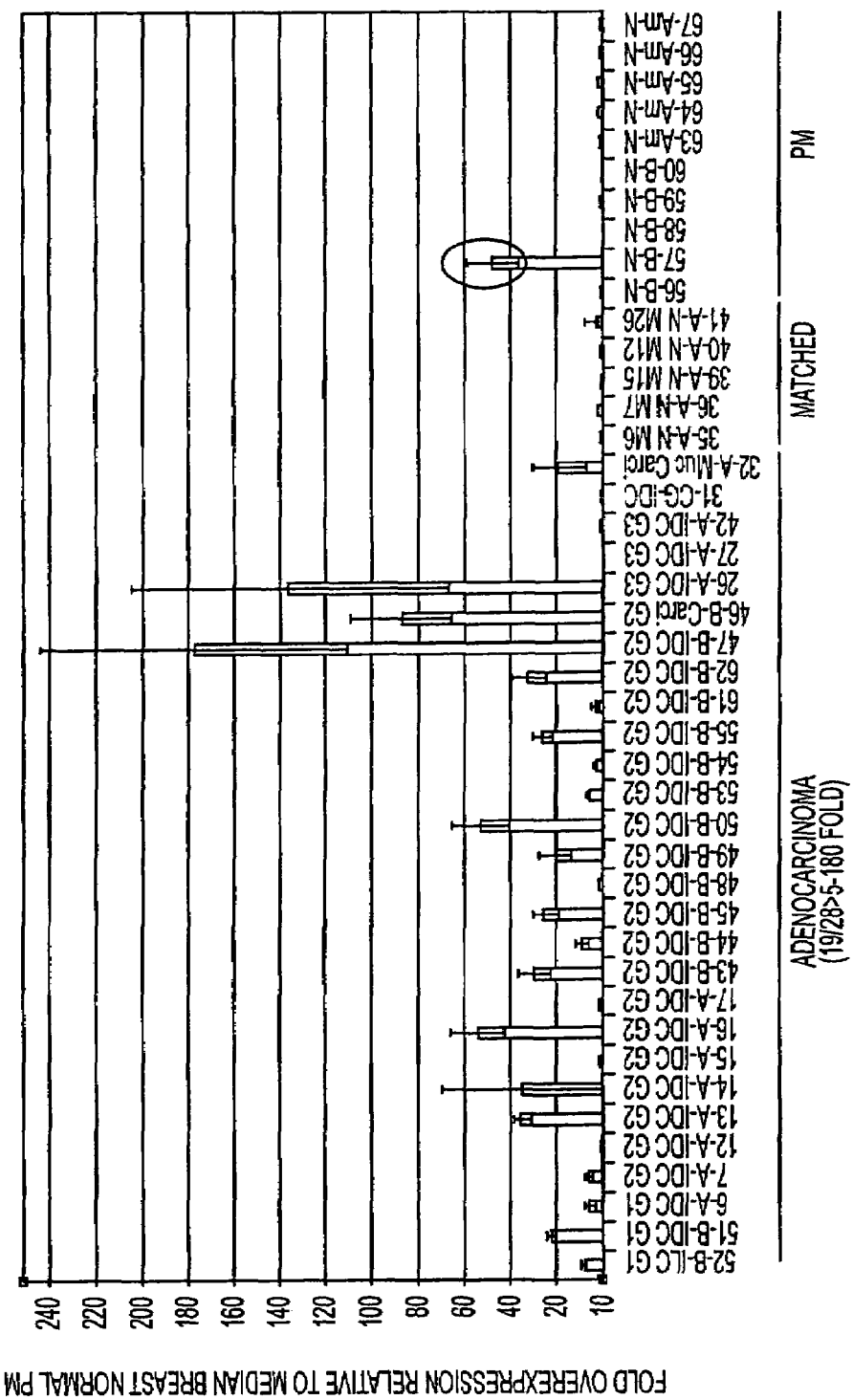
FIG. 7 is a histogram showing expression of the CEA6_HUMAN (SEQ ID NO:13) Carcinoembryonic antigen-related cell adhesion molecule 6 (T10888) transcripts, which are detectable by amplicon as depicted in sequence name T10888 junc11-17, in normal and cancerous breast tissues.

FIG. 7 is a histogram showing over expression of the above-indicated CEA6_HUMAN Carcinoembryonic antigen-related cell adhesion molecule 6 transcripts in cancerous breast samples relative to the normal samples. Values represent the average of duplicate experiments. Error bars indicate the minimal and maximal values obtained. The number and percentage of samples that exhibit at least 5 fold over-expression, out of the total number of samples tested, is indicated in the bottom.

As is evident from FIG. 7, the expression of CEA6_HUMAN Carcinoembryonic antigen-related cell adhesion molecule 6 transcripts detectable by the above amplicon(s) in cancer samples was significantly higher than in the non-cancerous samples (Sample Nos. 56-60, 63-67 Table 1, "Tissue samples in testing panel"). Notably an overexpression of at least 5 fold was found in 19 out of 28 adenocarcinoma samples.

Statistical analysis was applied to verify the significance of these results, as described below.

The P value for the difference in the expression levels of CEA6_HUMAN Carcinoembryonic antigen-related cell adhesion molecule 6 transcripts detectable by the above amplicon(s) in breast cancer samples versus the normal tissue samples was determined by T test as 2.00E-03.

Threshold of 5 fold overexpression was found to differentiate between cancer and normal samples with P value of 8.44E-03 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: T10888junc11-17F (SEQ ID NO:830) forward primer; and T10888junc11-17R reverse primer.

The present invention also preferably encompasses any amplicon obtained through the use of any suitable primer pair; for example, for the above experiment, the following amplicon was obtained as a non-limiting illustrative example only of a suitable amplicon: T10888junc11-17. TABLE-US-00131 T10888junc11-17F (SEQ ID NO: 830) CCAG-CAATCCACACAAGAGCT T10888junc11-17R (SEQ ID NO: 831) CAGGGTCTGGTCCAATCAGAG T10888junc11-17 (SEQ ID NO: 832) CCAGCAATCCACA-CAAGAGCTCTTTATCCCCAACATCACT-GTGAATAATAGC GGATCCTATATGTGCCAAGCCCAT-AACTCAGCCACTGGCCTCAATAGGACCACAGT CACGATGATCACAGTCTCTGATTGGACCAGACCCTG Expression of CEA6_HUMAN Carcinoembryonic Antigen-Related Cell Adhesion Molecule 6 T10888 Transcripts which are Detectable by Amplicon as Depicted in Sequence Name T10888junc11-17 (SEQ ID NO:832) in Different Normal Tissues Expression of CEA6_HUMAN Carcinoembryonic antigen-related cell adhesion molecule 6 transcripts detectable by or according to T10888 junc 1-17 amplicon(s) (SEQ ID NO:832) and T10888 junc11-17F (SEQ ID NO:830) and T10888 junc11-17R (SEQ ID NO:831) was measured by real time PCR. In parallel the expression of four housekeeping genes--RPL19 (GenBank Accession No. NM.sub.--000981 (SEQ ID NO:934); RPL19 amplicon (SEQ ID NO:937)), TATA box (GenBank Accession No. NM.sub.--003194 (SEQ ID NO:938); TATA amplicon (SEQ ID NO:941)), UBC (GenBank Accession No. BC000449 (SEQ ID NO:942); amplicon--Ubiquitin-amplicon (SEQ ID NO:945 ) and SDHA (GenBank Accession No. NM.sub.--004168 (SEQ ID NO:922); amplicon--SDHA-amplicon (SEQ ID NO:925)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 2 "Tissue samples in normal panel" above), to obtain a value of relative expression of each sample relative to median of the ovary samples. Primers and amplicon are as above.

Figure 8:
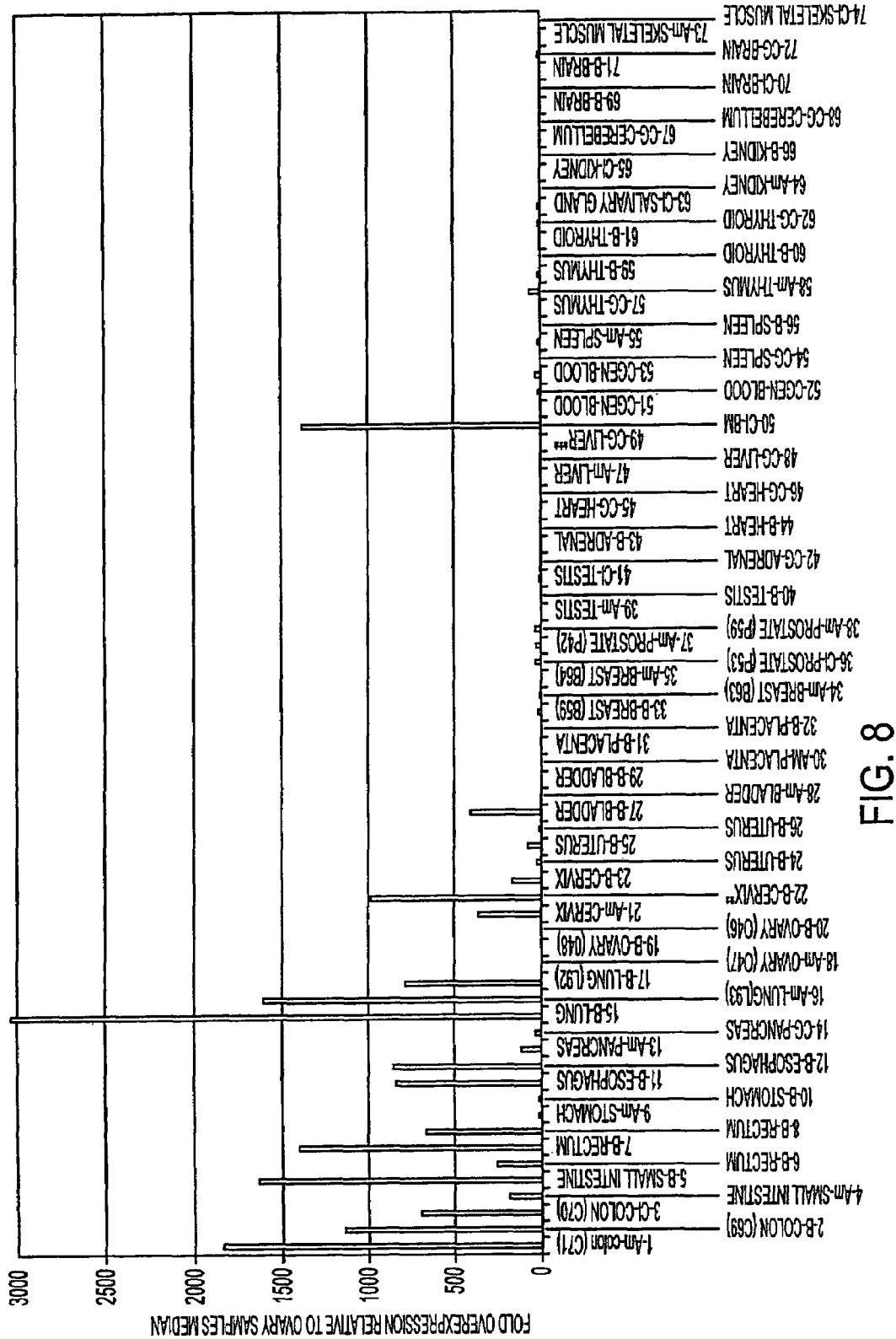
FIG. 8 is a histogram showing the expression of CEA6_HUMAN (SEQ ID NO:13) Carcinoembryonic antigen-related cell adhesion molecule 6 (T10888 transcripts which are detectable by amplicon as depicted in sequence name T10888junc11-17 (SEQ ID NO:832) in different normal tissues.

The results are presented in FIG. 8, demonstrating the expression of CEA6_HUMAN Carcinoembryonic antigen-related cell adhesion molecule 6 T10888 transcripts, which are detectable by amplicon as depicted in sequence name T10888junc11-17 (SEQ ID NO:832), in different normal tissues.

Description for Cluster T39971

Cluster T39971 features 4 transcript(s) and 28 segment(s) of interest, the names for which are given in Tables 1 and 2, respectively, the sequences themselves are given at the end of the application. The selected protein variants are given in table 3. TABLE-US-00132 TABLE 1 Transcripts of interest Transcript Name Sequence ID No. T39971_T10 18 T39971_T12 19 T39971_T16 20 T39971_T5 21

TABLE-US-00133 TABLE 2 Segments of interest Segment Name Sequence ID No. T39971_node_0 22 T39971_node_18 23 T39971_node_21 24 T39971_node_22 25 T39971_node_23 26 T39971_node_31 27 T39971_node_33 28 T39971_node_7 29 T39971_node_1 30 T39971_node_10 31 T39971_node_11 32 T39971_node_12 33 T39971_node_15 34 T39971_node_16 35 T39971_node_17 36 T39971_node_26 37 T39971_node_27 38 T39971_node_28 39 T39971_node_29 40 T39971_node_3 41 T39971_node_30 42 T39971_node_34 43 T39971_node_35 44 T39971_node_36 45 T39971_node_4 46 T39971_node_5 47 T39971_node_8 48 T39971_node_9 49

TABLE-US-00134 TABLE 3 Proteins of interest Protein Name Sequence ID No. T39971_P6 51 T39971_P9 52 T39971_P11 53 T39971_P12 54

These sequences are variants of the known protein Vitronectin precursor (SwissProt accession identifier VTNC_HUMAN; known also according to the synonyms Serum spreading factor; S-protein; V75), SEQ ID NO:50, referred to herein as the previously known protein.

Protein Vitronectin precursor (SEQ ID NO:50) is known or believed to have the following function(s): Vitronectin is a cell adhesion and spreading factor found in serum and tissues. Vitronectin interacts with glycosaminoglycans and proteoglycans. Is recognized by certain members of the integrin family and serves as a cell-to-substrate adhesion molecule. Inhibitor of the membrane-damaging effect of the terminal cytolytic complement pathway. The sequence for protein Vitronectin precursor is given at the end of the application, as "Vitronectin precursor amino acid sequence" (SEQ ID NO:50). Known polymorphisms for this sequence are as shown in Table 4. TABLE-US-00135 TABLE 4 Amino acid mutations for Known Protein SNP position(s) on amino acid sequence Comment 122 A→S. /FTId=VAR_012983. 268 R→Q. /FTId=VAR_012984. 400 T→M. /FTId=VAR_012985. 50 C→N 225 S→N 366 A→T Protein Vitronectin precursor (SEQ ID NO:50) localization is believed to be Extracellular.

The previously known protein also has the following indication(s) and/or potential therapeutic use(s): Cancer, melanoma. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Alphavbeta3 integrin antagonist; Apoptosis agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer.

The following GO Annotation(s) apply to the previously known protein. The following annotation(s) were found: immune response; cell adhesion, which are annotation(s) related to Biological Process; protein binding; heparin binding, which are annotation(s) related to Molecular Function; and extracellular space, which are annotation(s) related to Cellular Component.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster T39971 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 9 refer to weighted expression of ESTs in each category, as "parts per million" (ratio of the expression of ESTs for a particular cluster to the expression of all ESTs in that category, according to parts per million).

Figure 9:
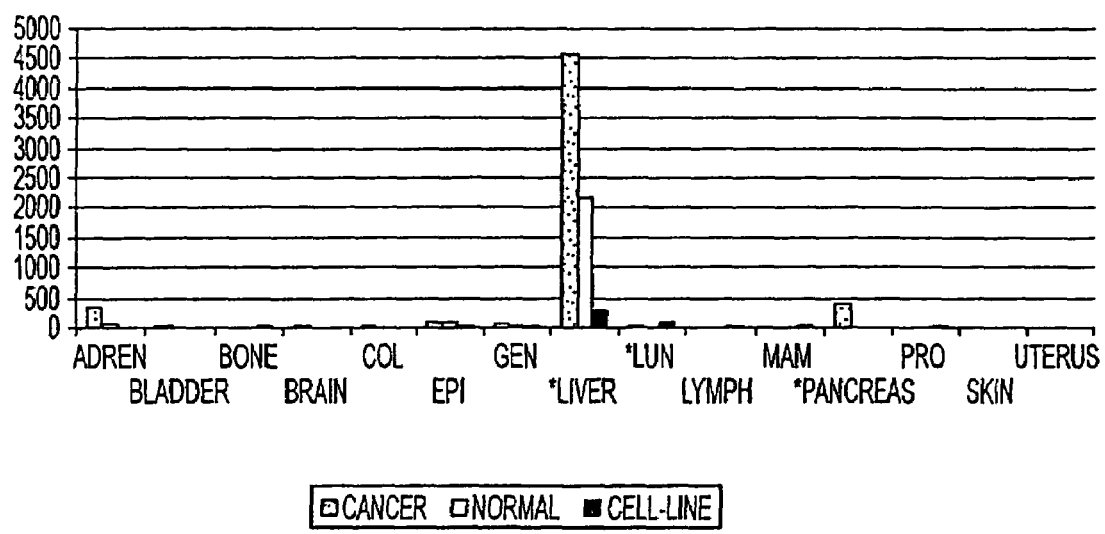
FIG. 9 is a histogram showing Cancer and cell-line vs. normal tissue expression for Cluster T39971, demonstrating overexpression in liver cancer, lung malignant tumors and pancreas carcinoma.

Overall, the following results were obtained as shown with regard to the histograms in FIG. 9 and Table 5. This cluster is overexpressed (at least at a minimum level) in the following pathological conditions: liver cancer, lung malignant tumors and pancreas carcinoma. TABLE-US-00136 TABLE 5 Normal tissue distribution Name of Tissue Number adrenal 60 bladder 0 Bone 0 Brain 9 Colon 0 epithelial 79 general 29 Liver 2164 Lung 0 lymph nodes 0 breast 0 pancreas 0 prostate 0 Skin 0 uterus 0

TABLE-US-00137 TABLE 6 P values and ratios for expression in cancerous tissue Name of Tissue P1 P2 SP1 R3 SP2 R4 adrenal 6.9e-01 7.4e-01 2.0e-02 2.3 5.3e-02 1.8 bladder 5.4e-01 6.0e-01 5.6e-01 1.8 6.8e-01 1.5 Bone 1 6.7e-01 1 1.0 7.0e-01 1.4 Brain 8.0e-01 8.6e-01 3.0e-01 1.9 5.3e-01 1.2 Colon 4.2e-01 4.8e-01 7.0e-01 1.6 7.7e-01 1.4 epithelial 6.6e-01 5.7e-01 1.0e-01 0.8 8.7e-01 0.6 general 5.1e-01 3.8e-01 9.2e-08 1.6 8.3e-04 1.3 Liver 1 6.7e-01 2.3e-03 0.3 1 0.2 Lung 2.4e-01 9.1e-02 1.7e-01 4.3 8.1e-03 5.0 lymph nodes 1 5.7e-01 1 1.0 5.8e-01 2.3 breast 1 6.7e-01 1 1.0 8.2e-01 1.2 pancreas 9.5e-02 1.8e-01 1.5e-11 6.5 8.2e-09 4.6 prostate 7.3e-01 6.0e-01 6.7e-01 1.5 5.6e-01 1.7 Skin 1 4.4e-01 1 1.0 6.4e-01 1.6 uterus 5.0e-01 2.6e-01 1 1.1 8.0e-01 1.4

As noted above, cluster T39971 features 4 transcript(s), which were listed in Table 1 above. These transcript(s) encode for protein(s) which are variant(s) of protein Vitronectin precursor (SEQ ID NO:50). A description of each variant protein according to the present invention is now provided.

Variant protein T39971_P6 (SEQ ID NO:51) according to the present invention has an amino acid sequence as given at the end of the application; it is encoded by transcript(s) T39971_T5 (SEQ ID NO:21). An alignment is given to the known protein (Vitronectin precursor (SEQ ID NO:50)) at the end of the application. One or more alignments to one or more previously published protein sequences are given at the end of the application. A brief description of the relationship of the variant protein according to the present invention to each such aligned protein is as follows:

Comparison report between T39971_P6 (SEQ ID NO:51) and VTNC_HUMAN (SEQ ID NO:50):

1. An isolated chimeric polypeptide encoding for T39971_P6 (SEQ ID NO:51), comprising a first amino acid sequence being at least 90% homologous to MAPLRPLLI-LALLAWVALADQESCKGRCTEGFNVD-KKCQCDELCSYYQSCCTDYTAEC KPQVTRGDVFTM-PEDEYTVYDDGEEKNNATVHEQVGGPSLTSDLQAQ SKGNPEQTPV LKPEEEAPAPEVGASKPEGIDSRPETL-HPGRPQPPAEEELCSGKPFDAFTDLKNGSLFAFR GQYCYELDEKAVRPGYPKLIRDVWGIEG-PIDAAFTRINCQGKTYLFKGSQYWRFEDGV LDP-DYPRNISDGFDGIPDNVDAALALPAH-SYSGRERVYFFKG corresponding to amino acids 1-276 of VTNC_HUMAN (SEQ ID NO:50), which also corresponds to amino acids 1-276 of T39971_P6 (SEQ ID NO:51), and a second amino acid sequence being at least 70%, optionally at least 80%, preferably at least 85%, more preferably at least 90% and most preferably at least 95% homologous to a polypeptide having the sequence TQGWGD (SEQ ID NO:1003) corresponding to amino acids 277-283 of T39971_P6 (SEQ ID NO:51), wherein said first and second amino acid sequences are contiguous and in a sequential order.

2. An isolated polypeptide encoding for a tail of T39971_P6 (SEQ ID NO:51), comprising a polypeptide being at least 70%, optionally at least about 80%, preferably at least about 85%, more preferably at least about 90% and most preferably at least about 95% homologous to the sequence TQGVVGD (SEQ ID NO:1003) in T39971_P6 (SEQ ID NO:51).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P6 (SEQ ID NO:51) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein T39971_P6 (SEQ ID NO:51) sequence provides support for the deduced sequence of this variant protein according to the present invention). TABLE-US-00138 TABLE 7 Amino acid mutations SNP position(s) on amino acid Alternative sequence amino acid(s) Previously known SNP? 122 A→S Yes 145 G→No 268 R→Q Yes 280 V→A Yes 180 C→No 180 C→W No 192 Y→No 209 A→No 211 T→No 267 G→No 267 G→A No 268 R→No Variant protein T39971_P6 (SEQ ID NO:51) is encoded by the following transcript(s): T39971_T5 (SEQ ID NO:21), for which the sequence(s) is/are given at the end of the application. The coding portion of transcript T39971_T5 (SEQ ID NO:21) is shown in bold; this coding portion starts at position 756 and ends at position 1604. The transcript also has the following SNPs as listed in Table 8 (given according to their position on the nucleotide sequence, with the alternative nucleic acid listed; the last column indicates whether the SNP is known or not; the presence of known SNPs in variant protein T39971_P6 (SEQ ID NO:51) sequence provides support for the deduced sequence of this variant protein according to the present invention). TABLE-US-00139 TABLE 8 Nucleic acid SNPs SNP position on nucleotide Alternative sequence nucleic acid Previously known SNP? 417 G→C Yes 459 T→C Yes 1387 C→No 1406→A No 1406→G No 1555 G→No 1555 G→C No 1558 G→No 1558 G→A Yes 1594 T→C Yes 1642 T→C Yes 1770 C→T Yes 529 G→T Yes 1982 A→G No 2007 G→No 2029 T→C No 2094 T→C No 2117 C→G No 2123 C→T Yes 2152 C→T Yes 2182 G→T No 2185 A→C No 2297 T→C Yes 1119 G→T Yes 2411 G→No 2411 G→T No 2487 T→C Yes 1188 G→No 1295 C→No 1295 C→G No 1324→T No 1331 C→No 1381 C→No Variant protein T39971_P9 (SEQ ID NO:52) according to the present invention has an amino acid sequence as given at the end of the application; it is encoded by transcript(s) T39971_T10 (SEQ ID NO:18). An alignment is given to the known protein (Vitronectin precursor (SEQ ID NO:50)) at the end of the application. One or more alignments to one or more previously published protein sequences are given at the end of the application. A brief description of the relationship of the variant protein according to the present invention to each such aligned protein is as follows:

Comparison report between T39971_P9 (SEQ ID NO:52) and VTNC_HUMAN (SEQ ID NO:50):

1. An isolated chimeric polypeptide encoding for T39971_P9 (SEQ ID NO:52), comprising a first amino acid sequence being at least 90% homologous to MAPLRPLLI-LALLAWVALADQESCKGRCTEGFNVD-KKCQCDELCSYYQSCCTDYTAEC KPQVTRGDVFTM-PEDEYTVYDDGEEKNNATVHEQVGGPSLTSDLQAQ SKGNPEQTPV LKPEEEAPAPEVGASKPEGIDSRPETL-HPGRPQPPAEEELCSGKPFDAFTDLKNGSLFAFR GQYCYELDEKAVRPGYPKLIRDVWGIEG-PIDMFTRINCQGKTYLFKGSQYWRFEDGV LDP-DYPRNISDGFDGIPDNVDAALALPAH-SYSGRERVYFFKGKQYWEYQFQHQPSQEE CEGSSLSAVFEHFAMMQRDSWEDIFELLFWGRT corresponding to amino acids 1-325 of VTNC_HUMAN (SEQ ID NO:50), which also corresponds to amino acids 1-325 of T39971_P9 (SEQ ID NO:52), and a second amino acid sequence being at least 90% homologous to SGMAPRPSLAKKQRFRHRNRKGYR-SQRGHSRGRNONSRRPSRATWLSLFSSEESNLGA NNYDDYRMDWLVPATCEPIQSVFFFSGD-KYYRVNLRTRRVDTVDPPYPRSIAQYWLGC PAPGHL corresponding to amino acids 357-478 of VTNC_HUMAN (SEQ ID NO:50), which also corresponds to amino acids 326-447 of T39971_P9 (SEQ ID NO:52), wherein said first and second amino acid sequences are contiguous and in a sequential order.

2. An isolated chimeric polypeptide encoding for an edge portion of T39971_P9 (SEQ ID NO:52), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TS, having a structure as follows: a sequence starting from any of amino acid numbers 325-x to 325; and ending at any of amino acid numbers 326+((n−2)-x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P9 (SEQ ID NO:52) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein T39971_P9 (SEQ ID NO:52) sequence provides support for the deduced sequence of this variant protein according to the present invention). TABLE-US-00140 TABLE 9 Amino acid mutations SNP position(s) on amino acid Alternative sequence amino acid(s) Previously known SNP? 122 A→S Yes 145 G→No 268 R→Q Yes 328 M→T No 350 S→P No 369 T→M Yes 379 S→I No 380 N→T No 180 C→No 180 C→W No 192 Y→No 209A→No 211 T→No 267 G→No 267 G→A No 268 R→No Variant protein T39971_P9 (SEQ ID NO:52) is encoded by the following transcript(s): T39971_T10 (SEQ ID NO:18), for which the sequence(s) is/are given at the end of the application. The coding portion of transcript T39971_T10 (SEQ ID NO: 18) is shown in bold; this coding portion starts at position 756 and ends at position 2096. The transcript also has the following SNPs as listed in Table 10 (given according to their position on the nucleotide sequence, with the alternative nucleic acid listed; the last column indicates whether the SNP is known or not; the presence of known SNPs in variant protein T39971_P9 (SEQ ID NO:52) sequence provides support for the deduced sequence of this variant protein according to the present invention). TABLE-US-00141 TABLE 10 Nucleic acid SNPs SNP position on nucleotide Alternative sequence nucleic acid Previously known SNP? 417 G→C Yes 459 T→C Yes 1387 C→No 1406→A No 1406→G No 1555 G→No 1555 G→C No 1558 G→No 1558 G→A Yes 1738 T→C No 1803 T→C No 1826 C→G No 529 G→T Yes 1832 C→T Yes 1861 C→T Yes 1891 G→T No 1894 A→C No 2006 T→C Yes 2120 G→No 2120 G→T No 2196 T→C Yes 1119

G→T Yes 1188 G→No 1295 C→No 1295 C→G No 1324→T No 1331 C→No 1381 C→No

Variant protein T39971_P11 (SEQ ID NO:53) according to the present invention has an amino acid sequence as given at the end of the application; it is encoded by transcript(s) T39971_T12 (SEQ ID NO:19). An alignment is given to the known protein (Vitronectin precursor (SEQ ID NO:50)) at the end of the application. One or more alignments to one or more previously published protein sequences are given at the end of the application. A brief description of the relationship of the variant protein according to the present invention to each such aligned protein is as follows:

Comparison report between T39971_P11 (SEQ ID NO:53) and VTNC_HUMAN (SEQ ID NO:50):

1. An isolated chimeric polypeptide encoding for T39971_P11 (SEQ ID NO:53), comprising a first amino acid sequence being at least 90% homologous to MAPLRPLLI-LALLAWVALADQESCKGRCTEGFNVD-KKCQCDELCSYYQSCCTDYTAEC KPQVTRGDVFTM-PEDEYTVYDDGEEKNNATVHEQVGGPSLTSDLQAQ SKGNPEQTPV LKPEEEAPAPEVGASKPEGIDSRPETL-HPGRPQPPAEEELCSGKPFDAFTDLKNGSLFAFR GQYCYELDEKAVRPGYPKLIRDVWGIEG-PIDMFTRINCQGKTYLFKGSQYWRFEDGV LDP-DYPRNISDGFDGIPDNVDAALALPAH-SYSGRERVYFFKGKQYWEYQFQHQPSQEE CEGSSLSAVFEHFAMMQRDSWEDIFELLFWGRTS corresponding to amino acids 1-326 of VTNC_HUMAN (SEQ ID NO:50), which also corresponds to amino acids 1-326 of T39971_P11 (SEQ ID NO:53), and a second amino acid sequence being at least 90% homologous to DKYYRVNLR-TRRVDTVDPPYPRSIAQYWLGCPAPGHL corresponding to amino acids 442-478 of VTNC_HUMAN (SEQ ID NO:50), which also corresponds to amino acids 327-363 of T39971_P11 (SEQ ID NO:53), wherein said first and second amino acid sequences are contiguous and in a sequential order.

2. An isolated chimeric polypeptide encoding for an edge portion of T39971_P11 (SEQ ID NO:53), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326-x to 326; and ending at any of amino acid numbers 327+((n−2)-x), in which x varies from 0 to n−2.

Comparison report between T39971_P11 (SEQ ID NO:53) and Q9BSH7 (SEQ ID NO:833):

1. An isolated chimeric polypeptide encoding for T39971_P11 (SEQ ID NO:53), comprising a first amino acid sequence being at least 90% homologous to MAPLRPLLI-LALLAWVALADQESCKGRCTEGFNVD-KKCQCDELCSYYQSCCTDYTAEC KPQVTRGDVFTM-PEDEYTVYDDGEEKNNATVHEQVGGPSLTSDLQAQ SKGNPEQTPV LKPEEEAPAPEVGASKPEGIDSRPETL-HPGRPQPPAEEELCSGKPFDAFTDLKNGSLFAFR GQYCYELDEKAVRPGYPKLIRDVWGIEG-PIDAAFTRINCQGKTYLFKGSQYWRFEDGV LDP-DYPRNISDGFDGIPDNVDMAALALPAH-SYSGRERVYFFKGKQYWEYQFQHQPSQEE CEGSSLSAVFEHFAMMQRDSWEDIFELLFWGRTS corresponding to amino acids 1-326 of Q9BSH7, which also corresponds to amino acids 1-326 of T39971_P11 (SEQ ID NO:53), and a second amino acid sequence being at least 90% homologous to DKYYRVNLRTRRVDTVDPPYPRSIAQY-WLGCPAPGHL corresponding to amino acids 442-478 of Q9BSH7, which also corresponds to amino acids 327-363 of T39971_P11 (SEQ ID NO:53), wherein said first and second amino acid sequences are contiguous and in a sequential order.

2. An isolated chimeric polypeptide encoding for an edge portion of T39971_P11 (SEQ ID NO:53), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326-x to 326; and ending at any of amino acid numbers 327+((n−2)-x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P11 (SEQ ID NO:53) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein T39971_P11 (SEQ ID NO:53) sequence provides support for the deduced sequence of this variant protein according to the present invention). TABLE-US-00142 TABLE 11 Amino acid mutations SNP position(s) on amino acid Alternative sequence amino acid(s) Previously known SNP? 122 A→S Yes 145 G→No 268 R→Q Yes 180 C→No 180 C→W No 192 Y→No 209 A→No 211 T→No 267 G→No 267 G→A No 268 R→No Variant protein T39971_P11 (SEQ ID NO:53) is encoded by the following transcript(s): T39971_T12 (SEQ ID NO:19), for which the sequence(s) is/are given at the end of the application. The coding portion of transcript T39971_T12 (SEQ ID NO:19) is shown in bold; this coding portion starts at position 756 and ends at position 1844. The transcript also has the following SNPs as listed in Table 12 (given according to their position on the nucleotide sequence, with the alternative nucleic acid listed; the last column indicates whether the SNP is known or not; the presence of known SNPs in variant protein T39971_P11 (SEQ ID NO:53) sequence provides support for the deduced sequence of this variant protein according to the present invention). TABLE-US-00143 TABLE 12 Nucleic acid SNPs SNP position on nucleotide Alternative sequence nucleic acid Previously known SNP? 417 G→C Yes 459 T→C Yes 1387 C→No 1406→A No 1406→G No 1555 G→No 1555 G→C No 1558 G→No 1558 G→A Yes 1754 T→C Yes 1868 G→No 1868 G→T No 529 G→T Yes 1944 T→C Yes 1119 G→T Yes 1188 G→No 1295 C→No 1295 C→G No 1324→T No 1331 C→No 1381 C→No Variant protein T39971_P12 (SEQ ID NO:54) according to the present invention has an amino acid sequence as given at the end of the application; it is encoded by transcript(s) T39971_T16 (SEQ ID NO:20). An alignment is given to the known protein (Vitronectin precursor (SEQ ID NO:50)) at the end of the application. One or more alignments to one or more previously published protein sequences are given at the end of the application. A brief description of the relationship of the variant protein according to the present invention to each such aligned protein is as follows:

Comparison report between T39971_P12 (SEQ ID NO:54) and VTNC_HUMAN (SEQ ID NO:50):

1. An isolated chimeric polypeptide encoding for T39971_P12 (SEQ ID NO:54), comprising a first amino acid sequence being at least 90% homologous to MAPLRPLLI- LALLAWVALADQESCKGRCTEGFNVD- KKCQCDELCSYYQSCCTDYTAEC KPQVTRGDVFTM- PEDEYTVYDDGEEKNNATVHEQVGGPSLTSDLQAQ SKGNPEQTPV LKPEEEAPAPEVGASKPEGIDSRPETL- HPGRPQPPAEEELCSGKPFDAFTDLKNGSLFAFR GQYCYELDEKAVRPGYPKLIRDVWGIEG- PIDAAFTRINCQGKTYLFK corresponding to amino acids 1-223 of VTNC_HUMAN (SEQ ID NO:50), which also corresponds to amino acids 1-223 of T39971_P12 (SEQ ID NO:54), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO:1004) corresponding to amino acids 224-238 of T39971_P12 (SEQ ID NO:54), wherein said first and second amino acid sequences are contiguous and in a sequential order.

2. An isolated polypeptide encoding for a tail of T39971_P12 (SEQ ID NO:54), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO:1004) in T39971_P12 (SEQ ID NO:54).

Comparison report between T39971_P12 (SEQ ID NO:54) and Q9BSH7:

1. An isolated chimeric polypeptide encoding for T39971_P12 (SEQ ID NO:54), comprising a first amino acid sequence being at least 90% homologous to MAPLRPLLI- LALLAWVALADQESCKGRCTEGFNVD- KKCQCDELCSYYQSCCTDYTAEC KPQVTRGDVFTM- PEDEYTVYDDGEEKNNATVHEQVGGPSLTSDLQAQ SKGNPEQTPV LKPEEEAPAPEVGASKPEGIDSRPETL- HPGRPQPPAEEELCSGKPFDAFTDLKNGSLFAFR GQYCYELDEKAVRPGYPKLIRDVWGIEG- PIDAAFTRINCQGKTYLFK corresponding to amino acids 1-223 of Q9BSH7, which also corresponds to amino acids 1-223 of T39971_P12 (SEQ ID NO:54), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO:1004) corresponding to amino acids 224-238 of T39971_P12 (SEQ ID NO:54), wherein said first and second amino acid sequences are contiguous and in a sequential order.

2. An isolated polypeptide encoding for a tail of T39971_P12 (SEQ ID NO:54), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO:1004) in T39971_P12 (SEQ ID NO:54).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P12 (SEQ ID NO:54) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein T39971_P 12 (SEQ ID NO:54) sequence provides support for the deduced sequence of this variant protein according to the present invention). TABLE-US-00144 TABLE 13 Amino acid mutations SNP position(s) on amino acid Alternative sequence amino acid(s) Previously known SNP? 122 A→S Yes 145 G→No 180 C→No 180 C→W No 192 Y→No 209 A→No 211 T→No Variant protein T39971_P12 (SEQ ID NO:54) is encoded by the following transcript(s): T39971_T16 (SEQ ID NO:20), for which the sequence(s) is/are given at the end of the application. The coding portion of transcript T39971_T16 (SEQ ID NO:20) is shown in bold; this coding portion starts at position 756 and ends at position 1469. The transcript also has the following SNPs as listed in Table 14 (given according to their position on the nucleotide sequence, with the alternative nucleic acid listed; the last column indicates whether the SNP is known or not; the presence of known SNPs in variant protein T39971_P12 (SEQ ID NO:54) sequence provides support for the deduced sequence of this variant protein according to the present invention). TABLE-US-00145 TABLE 14 Nucleic acid SNPs SNP position on nucleotide Alternative sequence nucleic acid Previously known SNP? 417 G→C Yes 459 T→C Yes 1387 C→No 1406→A No 1406→G No 529 G→T Yes 1119 G→T Yes 1188 G→No 1295 C→No 1295 C→G No 1324→T No 1331 C→No 1381 C→No As noted above, cluster T39971 features 28 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T39971_node.sub.--0 (SEQ ID NO:22) according to the present invention is supported by 76 libraries. The number of libraries was determined as previously described. This segment can be found in the following transcript(s): T39971_T1 (SEQ ID NO:18), T39971_T12 (SEQ ID NO:19), T39971_T16 (SEQ ID NO:20) and T39971_T5 (SEQ ID NO:21). Table 15 below describes the starting and ending position of this segment on each transcript. TABLE-US-00146 TABLE 15 Segment location on transcripts Segment Segment Transcript name starting position ending position T39971_T10 (SEQ ID NO: 18) 1 810 T39971_T12 (SEQ ID NO: 19)1 810 T39971_T16 (SEQ ID NO: 20)1 810 T39971_T5 (SEQ ID NO: 21) 1 810

Segment cluster T39971_node.sub.--18 (SEQ ID NO:23) according to the present invention is supported by 1 libraries. The number of libraries was determined as previously described. This segment can be found in the following transcript(s): T39971_T16 (SEQ ID NO:20). Table 16 below describes the starting and ending position of this segment on each transcript. TABLE-US-00147 TABLE 16 Segment location on transcripts Segment Segment Transcript name starting position ending position T39971_T16 (SEQ ID NO: 20) 1425 1592

Segment cluster T39971_node.sub.--21 (SEQ ID NO:24) according to the present invention is supported by 99 libraries. The number of libraries was determined as previously described. This segment can be found in the following transcript(s): T39971_T10 (SEQ ID NO:18), T39971_T12 (SEQ ID NO:19) and T39971_T5 (SEQ ID NO:21). Table 17 below describes the starting and ending position of this segment on each transcript. TABLE-US-00148 TABLE 17 Segment location on transcripts Segment Segment Transcript name starting position ending position T39971_T10 (SEQ ID NO: 18) 1425 1581 T39971_T12 (SEQ ID NO: 19) 1425 1581 T39971_T5 (SEQ ID NO: 21) 1425 1581

Segment cluster T39971_node.sub.--22 (SEQ ID NO:25) according to the present invention is supported by 7 libraries. The number of libraries was determined as previously described. This segment can be found in the following transcript(s): T39971_T5 (SEQ ID NO:21). Table 18 below describes the starting and ending position of this segment on each transcript. TABLE-US-00149 TABLE 18 Segment location on transcripts Segment Segment Transcript name starting position ending position T39971_T5 (SEQ ID NO: 21) 1582 1779

Segment cluster T39971_node.sub.--23 (SEQ ID NO:26) according to the present invention is supported by 101 libraries. The number of libraries was determined as previously described. This segment can be found in the following transcript(s): T39971_T10 (SEQ ID NO:18), T39971_T12 (SEQ ID NO:19) and T39971_T5 (SEQ ID NO:21). Table 19 below describes the starting and ending position of this segment on each transcript. TABLE-US-00150 TABLE 19 Segment location on transcripts Segment Segment Transcript name starting position ending position T39971_T10 (SEQ ID NO: 18) 1582 1734 T39971_T12 (SEQ ID NO: 19) 1582 1734 T39971_T5 (SEQ ID NO: 21) 1780 1932

Segment cluster T39971_node.sub.--31 (SEQ ID NO:27) according to the present invention is supported by 94 libraries. The number of libraries was determined as previously described. This segment can be found in the following transcript(s): T39971_T10 (SEQ ID NO:18) and T39971_T5 (SEQ ID NO:21). Table 20 below describes the starting and ending position of this segment on each transcript. TABLE-US-00151 TABLE 20 Segment location on transcripts Segment Segment Transcript name starting position ending position T39971_T10 (SEQ ID NO: 18) 1847 1986 T39971_T5 (SEQ ID NO: 21) 2138 2277

Segment cluster T39971_node.sub.--33 (SEQ ID NO:28) according to the present invention is supported by 77 libraries. The number of libraries was determined as previously described. This segment can be found in the following transcript(s): T39971_T10 (SEQ ID NO:18), T39971_T12 (SEQ ID NO:19) and T39971_T5 (SEQ ID NO:21). Table 21 below describes the starting and ending position of this segment on each transcript. TABLE-US-00152 TABLE 21 Segment location on transcripts Segment Segment Transcript name starting position ending position T39971_T10 (SEQ ID NO: 18) 1987 2113 T39971_T12 (SEQ ID NO: 19) 1735 1861 T39971_T5 (SEQ ID NO: 21) 2278 2404

Segment cluster T39971_node.sub.--7 (SEQ ID NO:29) according to the present invention is supported by 87 libraries. The number of libraries was determined as previously described. This segment can be found in the following transcript(s): T39971_T11 (SEQ ID NO:18), T39971_T12 (SEQ ID NO:19), T39971_T16 (SEQ ID NO:20) and T39971_T5 (SEQ ID NO:21). Table 22 below describes the starting and ending position of this segment on each transcript. TABLE-US-00153 TABLE 22 Segment location on transcripts Segment Segment Transcript name starting position ending position T39971_T10 (SEQ ID NO: 18) 940 1162 T39971_T12 (SEQ ID NO: 19) 940 1162 T39971_T16 (SEQ ID NO: 20) 940 1162 T39971_T5 (SEQ ID NO: 21) 940 1162

According to an optional embodiment of the present invention, short segments related to the above cluster are also provided. These segments are up to about 120 bp in length, and so are included in a separate description.

Segment cluster T39971_node.sub.--1 (SEQ ID NO:30) according to the present invention can be found in the following transcript(s): T39971_T10 (SEQ ID NO:18), T39971_T12 (SEQ ID NO:19), T39971_T16 (SEQ ID NO:20) and T39971_T5 (SEQ ID NO:21). Table 23 below describes the starting and ending position of this segment on each transcript. TABLE-US-00154 TABLE 23 Segment location on transcripts Segment Segment Transcript name starting position ending position T39971_T10 (SEQ ID NO: 18) 811 819 T39971_T12 (SEQ ID NO: 19) 811 819 T39971_T16 (SEQ ID NO: 20) 811 819 T39971_T5 (SEQ ID NO: 21) 811 819

Segment cluster T39971_node.sub.--10 (SEQ ID NO:31) according to the present invention is supported by 77 libraries. The number of libraries was determined as previously described. This segment can be found in the following transcript(s): T39971_T10 (SEQ ID NO:18), T39971_T12 (SEQ ID NO:19), T39971_T16 (SEQ ID NO:20) and T39971_T5 (SEQ ID NO:21). Table 24 below describes the starting and ending position of this segment on each transcript. TABLE-US-00155 TABLE 24 Segment location on transcripts Segment Segment Transcript name starting position ending position T39971_T10 (SEQ ID NO: 18) 1189 1232 T39971_T12 (SEQ ID NO: 19) 1189 1232 T39971_T16 (SEQ ID NO: 20) 1189 1232 T39971_T5 (SEQ ID NO: 21) 1189 1232

Segment cluster T39971_node.sub.--11 (SEQ ID NO:32) according to the present invention is supported by 79 libraries. The number of libraries was determined as previously described. This segment can be found in the following transcript(s): T39971_T10 (SEQ ID NO:18), T39971_T12 (SEQ ID NO:19), T39971_T16 (SEQ ID NO:20) and T39971_T5 (SEQ ID NO:21). Table 25 below describes the starting and ending position of this segment on each transcript. TABLE-US-00156 TABLE 25 Segment location on transcripts Segment Segment Transcript name starting position ending position T39971_T10 (SEQ ID NO: 18) 1233 1270 T39971_T12 (SEQ ID NO: 19) 1233 1270 T39971_T16 (SEQ ID NO: 20) 1233 1270 T39971_T5 (SEQ ID NO: 21) 1233 1270

Segment cluster T39971_node.sub.--12 (SEQ ID NO:33) according to the present invention can be found in the following transcript(s): T39971_T10 (SEQ ID NO:18), T39971_T12 (SEQ ID NO:19), T39971_T16 (SEQ ID NO:20) and T39971_T5 (SEQ ID NO:21). Table 26 below describes the starting and ending position of this segment on each transcript. TABLE-US-00157 TABLE 26 Segment location on transcripts Segment Segment Transcript name starting position ending position T39971_T10 (SEQ ID NO: 18) 1271 1284 T39971_T12 (SEQ ID NO: 19) 1271 1284 T39971_T16 (SEQ ID NO: 20) 1271 1284 T39971_T5 (SEQ ID NO: 21) 1271 1284

Segment cluster T39971_node.sub.--15 (SEQ ID NO:34) according to the present invention is supported by 79 libraries. The number of libraries was determined as previously described. This segment can be found in the following transcript(s): T39971_T10 (SEQ ID NO:18), T39971_T12 (SEQ ID NO:19), T39971_T16 (SEQ ID NO:20) and T39971_T5 (SEQ ID NO:21). Table 27 below describes the starting and ending position of this segment on each transcript. TABLE-US-00158 TABLE 27 Segment location on transcripts Segment Segment Transcript name starting position ending position T39971_T10 (SEQ ID NO: 18) 1285 1316 T39971_T12 (SEQ ID NO: 19) 1285 1316 T39971_T16 (SEQ ID NO: 20) 1285 1316 T39971_T5 (SEQ ID NO: 21) 1285 1316

Segment cluster T39971_node.sub.--16 (SEQ ID NO:35) according to the present invention can be found in the following transcript(s): T39971_T10 (SEQ ID NO:18), T39971_T12 (SEQ ID NO:19), T39971_T16 (SEQ ID NO:20) and T39971_T5 (SEQ ID NO:21). Table 28 below describes the starting and ending position of this segment on each transcript. TABLE-US-00159 TABLE 28 Segment location on transcripts Segment Segment Transcript name starting position ending position T39971_T10 (SEQ ID NO: 18) 1317 1340 T39971_T12 (SEQ ID NO: 19) 1317 1340 T39971_T16 (SEQ ID NO: 20) 1317 1340 T39971_T5 (SEQ ID NO: 21) 1317 1340

Segment cluster T39971_node.sub.--17 (SEQ ID NO:36) according to the present invention is supported by 86 libraries. The number of libraries was determined as previously described. This segment can be found in the following transcript(s): T39971_T10 (SEQ ID NO:18), T39971_T12 (SEQ ID NO:19), T39971_T16 (SEQ ID NO:20) and T39971_T5 (SEQ ID NO:21). Table 29 below describes the starting and ending position of this segment on each transcript. TABLE-US-00160 TABLE 29 Segment location on transcripts Segment Segment Transcript name starting position ending position T39971_T10 (SEQ ID NO: 18) 1341 1424 T39971_T12 (SEQ ID NO: 19) 1341 1424 T39971_T16 (SEQ ID NO: 20) 1341 1424 T39971_T5 (SEQ ID NO: 21) 1341 1424

Segment cluster T39971_node.sub.--26 (SEQ ID NO:37) according to the present invention is supported by 85 libraries. The number of libraries was determined as previously described. This segment can be found in the following transcript(s): T39971_T5 (SEQ ID NO:21). Table 30 below describes the starting and ending position of this segment on each transcript. TABLE-US-00161 TABLE 30 Segment location on transcripts Segment Segment Transcript name starting position ending position T39971_T5 (SEQ ID NO: 21) 1933 1974

Segment cluster T39971_node.sub.--27 (SEQ ID NO:38) according to the present invention is supported by 90 libraries. The number of libraries was determined as previously described. This segment can be found in the following transcript(s): T39971_T5 (SEQ ID NO:21). Table 31 below describes the starting and ending position of this segment on each transcript. TABLE-US-00162 TABLE 31 Segment location on transcripts Segment Segment Transcript name starting position ending position T39971_T5 (SEQ ID NO: 21) 1975 2025

Segment cluster T39971_node.sub.--28 (SEQ ID NO:39) according to the present invention can be found in the following transcript(s): T39971_T10 (SEQ ID NO:18) and T39971_T5 (SEQ ID NO:21). Table 32 below describes the starting and ending position of this segment on each transcript. TABLE-US-00163 TABLE 32 Segment location on transcripts Segment Segment Transcript name starting position ending position T39971_T10 (SEQ ID NO: 18) 1735 1743 T39971_T5 (SEQ ID NO: 21) 2026 2034

Segment cluster T39971_node.sub.--29 (SEQ ID NO:40) according to the present invention is supported by 99 libraries. The number of libraries was determined as previously described. This segment can be found in the following transcript(s): T39971_T10 (SEQ ID NO 18) and T39971_T5 (SEQ ID NO:21). Table 33 below describes the starting and ending position of this segment on each transcript. TABLE-US-00164 TABLE 33 Segment location on transcripts Segment Segment Transcript name starting position ending position T39971_T10 (SEQ ID NO: 18) 1744 1838 T39971_T5 (SEQ ID NO: 21) 2035 2129

Segment cluster T39971_node.sub.--3 (SEQ ID NO:41) according to the present invention is supported by 78 libraries. The number of libraries was determined as previously described. This segment can be found in the following transcript(s): T39971_T10 (SEQ ID NO:18), T39971_T12 (SEQ ID NO:19), T39971_T16 (SEQ ID NO:20) and T39971_T5 (SEQ ID NO:21). Table 34 below describes the starting and ending position of this segment on each transcript. TABLE-US-00165 TABLE 34 Segment location on transcripts Segment Segment Transcript name starting position ending position T39971_T10 (SEQ ID NO: 18) 820 861 T39971_T12 (SEQ ID NO: 19) 820 861 T39971_T16 (SEQ ID NO: 20) 820 861 T39971_T5 (SEQ ID NO: 21) 820 861

Segment cluster T39971_node.sub.--30 (SEQ ID NO:42) according to the present invention can be found in the following transcript(s): T39971_T10 (SEQ ID NO:18) and T39971_T5 (SEQ ID NO:21). Table 35 below describes the starting and ending position of this segment on each transcript. TABLE-US-00166 TABLE 35 Segment location on transcripts Segment Segment Transcript name starting position ending position T39971_T10 (SEQ ID NO: 18) 1839 1846 T39971_T5 (SEQ ID NO: 21) 2130 2137

Segment cluster T39971_node.sub.--34 (SEQ ID NO:43) according to the present invention can be found in the following transcript(s): T39971_T10 (SEQ ID NO:18), T39971_T12 (SEQ ID NO:19) and T39971_T5 (SEQ ID NO:21). Table 36 below describes the starting and ending position of this segment on each transcript. TABLE-US-00167 TABLE 36 Segment location on transcripts Segment Segment Transcript name starting position ending position T39971_T10 (SEQ ID NO: 18) 2114 2120 T39971_T12 (SEQ ID NO: 19) 1862 1868 T39971_T5 (SEQ ID NO: 21) 2405 2411

Segment cluster T39971_node.sub.--35 (SEQ ID NO:44) according to the present invention can be found in the following transcript(s): T39971_T10 (SEQ ID NO:18), T39971_T12 (SEQ ID NO:19) and T39971_T5 (SEQ ID NO:21). Table 37 below describes the starting and ending position of this segment on each transcript. TABLE-US-00168 TABLE 37 Segment location on transcripts Segment Segment Transcript name starting position ending position T39971_T10 (SEQ ID NO: 18) 2121 2137 T39971_T12 (SEQ ID NO: 19) 1869 1885 T39971_T5 (SEQ ID NO: 21) 2412 2428

Segment cluster T39971_node.sub.--36 (SEQ ID NO:45) according to the present invention is supported by 51 libraries. The number of libraries was determined as previously described. This segment can be found in the following transcript(s): T39971_T10 (SEQ ID NO:18), T39971_T12 (SEQ ID NO:19) and T39971_T5 (SEQ ID NO:21). Table 38 below describes the starting and ending position of this segment on each transcript. TABLE-US-00169 TABLE 38 Segment location on transcripts Segment Segment Transcript name starting position ending position T39971_T10 (SEQ ID NO: 18) 2138 2199 T39971_T12 (SEQ ID NO: 19) 1886 1947 T39971_T5 (SEQ ID NO: 21) 2429 2490

Segment cluster T39971_node.sub.--4 (SEQ ID NO:46) according to the present invention can be found in the following transcript(s): T39971_T10 (SEQ ID NO:18), T39971_T12 (SEQ ID NO:19), T39971_T16 (SEQ ID NO:20) and T39971_T5 (SEQ ID NO:21). Table 39 below describes the starting and ending position of this segment on each transcript. TABLE-US-00170 TABLE 39 Segment location on transcripts Segment Segment Transcript name starting position ending position T39971_T10 (SEQ ID NO: 18) 862 881 T39971_T12 (SEQ ID NO: 19) 862 881 T39971_T16 (SEQ ID NO: 20) 862 881 T39971_T5 (SEQ ID NO: 21) 862 881

Segment cluster T39971_node.sub.--5 (SEQ ID NO:47) according to the present invention is supported by 80 libraries. The number of libraries was determined as previously described. This segment can be found in the following transcript(s): T39971_T10 (SEQ ID NO:18), T39971_T12 (SEQ ID NO:19), T39971_T16 (SEQ ID NO:20) and T39971_T5 (SEQ ID NO:2 1). Table 40 below describes the starting and ending position of this segment on each transcript. TABLE-US-00171 TABLE 40 Segment location on transcripts Segment Segment ending Transcript name starting position position T39971_T10 (SEQ ID NO: 18) 882 939 T39971_T12 (SEQ ID NO: 19) 882 939 T39971_T16 (SEQ ID NO: 20) 882 939 T39971_T5 (SEQ ID NO: 21) 882 939

Segment cluster T39971_node.sub.--8 (SEQ ID NO:48) according to the present invention can be found in the following transcript(s): T39971_T10 (SEQ ID NO:18), T39971_T12 (SEQ ID NO:19), T39971_T16 (SEQ ID NO:20) and T39971_T5 (SEQ ID NO:21). Table 41 below describes the starting and ending position of this segment on each transcript. TABLE-US-00172 TABLE 41 Segment location on transcripts Segment Segment ending Transcript name starting position position T39971_T10 (SEQ ID NO: 18) 1163 1168 T39971_T12 (SEQ ID NO: 19) 1163 1168 T39971_T16 (SEQ ID NO: 20) 1163 1168 T39971_T5 (SEQ ID NO: 21) 1163 1168

Segment cluster T39971_node.sub.--9 (SEQ ID NO:49) according to the present invention can be found in the following transcript(s): T39971_T10 (SEQ ID NO:18), T39971_T12 (SEQ ID NO:19), T39971_T16 (SEQ ID NO:20) and T39971_T5 (SEQ ID NO:21). Table 42 below describes the starting and ending position of this segment on each transcript. TABLE-US-00173 TABLE 42 Segment location on transcripts Segment Segment ending Transcript name starting position position T39971_T10 (SEQ ID NO: 18) 1169 1188 T39971_T12 (SEQ ID NO: 19) 1169 1188 T39971_T16 (SEQ ID NO: 20) 1169 1188 T39971_T5 (SEQ ID NO: 21) 1169 1188

Variant protein alignment to the previously known protein:

Sequence name: /tmp/xkraCL2OcZ/43L7YcPH7x:VT-NC_HUMAN (SEQ ID NO:50)

Sequence documentation:

Alignment of: T39971_P6 (SEQ ID NO:51 ).times.VT-NC_HUMAN (SEQ ID NO:50).

Alignment segment 1/1: TABLE-US-00174 Quality: 2774.00 Escore: 0 Matching length: 278 Total length: 278 Matching Percent 99.64 Matching Percent Identity: 99.64 Similarity: Total Percent Similarity: 99.64 Total Percent Identity: 99.64 Gaps: 0

```
Alignment: TABLE-US-00175 . . . 1
MAPLRPLLILALLAWVALADQESCKGRCTEGFNVDKKCQCDELCSYYQSC  50
||||||||||||||||||||||||||||||||||||||||||||||||||  1
MAPLRPLLILALLAWVALADQESCKGRCTEGFNVDKKCQCDELCSYYQSC  50 . . . 51

CTDYTAECKPQVTRGDVFTMPEDEYTVYDDGEEKNNATVHEQVGGPSLTS  100
||||||||||||||||||||||||||||||||||||||||||||||||||  51
CTDYTAECKPQVTRGDVFTMPEDEYTVYDDGEEKNNATVHEQVGGPSLTS  100 . . . 101

DLQAQSKGNPEQTPVLKPEEEAPAPEVGASKPEGIDSRPETLHPGRPQPP  150
||||||||||||||||||||||||||||||||||||||||||||||||||  101
DLQAQSKGNPEQTPVLKPEEEAPAPEVGASKPEGIDSRPETLHPGRPQPP  150 . . . 151

AEEELCSGKPFDAFTDLKNGSLFAFRGQYCYELDEKAVRPGYPKLIRDVW  200
||||||||||||||||||||||||||||||||||||||||||||||||||  151
AEEELCSGKPFDAFTDLKNGSLFAFRGQYCYELDEKAVRPGYPKLIRDVW  200 . . . 201

GIEGPIDAAFTRINCQGKTYLFKGSQYWRFEDGVLDPDYPRNISDGFDGI  250
||||||||||||||||||||||||||||||||||||||||||||||||||  201
GIEGPIDAAFTRINCQGKTYLFKGSQYWRFEDGVLDPDYPRNISDGFDGI  250 . . . 251

PDNVDAALALPAHSYSGRERVYFFKGTQ  278
||||||||||||||||||||||||||| |  251
PDNVDAALALPAHSYSGRERVYFFKGKQ  278
```

Sequence name: /tmp/X4DeeuSIB4/yMubSR5FPs:VT-NC_HUMAN (SEQ ID NO:50)

Sequence documentation:

Alignment of: T39971_P9 (SEQ ID NO:52).times.VT-NC_HUMAN (SEQ ID NO:50).

Alignment segment 1/1: TABLE-US-00176 Quality: 4430.00 Escore: 0 Matching length: 447 Total length: 478 Matching Percent 100.00 Matching Percent Identity: 100.00 Similarity: Total Percent Similarity: 93.51 Total Percent Identity: 93.51 Gaps: 1

```
Alignment: TABLE-US-00177 . . . 1
MAPLRPLLILALLAWVALADQESCKGRCTEGFNVDKKCQCDELCSYYQSC  50
||||||||||||||||||||||||||||||||||||||||||||||||||  1
MAPLRPLLILALLAWVALADQESCKGRCTEGFNVDKKCQCDELCSYYQSC  50 . . . 51

CTDYTAECKPQVTRGDVFTMPEDEYTVYDDGEEKNNATVHEQVGGPSLTS  100
||||||||||||||||||||||||||||||||||||||||||||||||||  51
CTDYTAECKPQVTRGDVFTMPEDEYTVYDDGEEKNNATVHEQVGGPSLTS  100 . . . 101

DLQAQSKGNPEQTPVLKPEEEAPAPEVGASKPEGIDSRPETLHPGRPQPP  150
```

-continued

```
                                                       101
|||||||||||||||||||||||||||||||||||||||||||||||||
DLQAQSKGNPEQTPVLKPEEEAPAPEVGASKPEGIDSRPETLHPGRPQPP    150   ... 151

AEEELCSGKPFDAFTDLKNGSLFAFRGQYCYELDEKAVRPGYPKLIRDVW    200
                                                       151
|||||||||||||||||||||||||||||||||||||||||||||||||
AEEELCSGKPFDAFTDLKNGSLFAFRGQYCYELDEKAVRPGYPKLIRDVW    200   ... 201

GIEGPIDAAFTRINCQGKTYLFKGSQYWRFEDGVLDPDYPRNISDGFDGI    250
                                                       201
|||||||||||||||||||||||||||||||||||||||||||||||||
GIEGPIDAAFTRINCQGKTYLFKGSQYWRFEDGVLDPDYPRNISDGFDGI    250   ... 251

PDNVDAALALPAHSYSGRERVYFFKGKQYWEYQFQHQPSQEECEGSSLSA    300
                                                       251
|||||||||||||||||||||||||||||||||||||||||||||||||
PDNVDAALALPAHSYSGRERVYFFKGKQYWEYQFQHQPSQEECEGSSLSA    300   ... 301

VFEHFAMMQRDSWEDIFELLFWGRT.........................    325
                                                       301
|||||||||||||||||||||||||
VFEHFAMMQRDSWEDIFELLFWGRTSAGTRQPQFISRDWHGVPGQVDAAM    350   ... 326

......SGMAPRPSLAKKQRFRHRNRKGYRSQRGHSRGRNQNSRRPSRAT    369
                                                       351
      |||||||||||||||||||||||||||||||||||||||||||
AGRIYISGMAPRPSLAKKQRFRHRNRKGYRSQRGHSRGRNQNSRRPSRAT    400   ... 370

WLSLFSSEESNLGANNYDDYRMDWLVPATCEPIQSVFFFSGDKYYRVNLR    419
                                                       401
|||||||||||||||||||||||||||||||||||||||||||||||||
WLSLFSSEESNLGANNYDDYRMDWLVPATCEPIQSVFFFSGDKYYRVNLR    450   ... 420

TRRVDTVDPPYPRSIAQYWLGCPAPGHL                          447
                                                       451
||||||||||||||||||||||||||||
TRRVDTVDPPYPRSIAQYWLGCPAPGHL                          478
```

Sequence name: /tmp/jvp/jvtnxNy/wxNSeFVZZw:VT-NC_HUMAN (SEQ ID NO:50)

Sequence documentation:

Alignment of: T39971_P11 (SEQ ID NO:53).times.VT-NC_HUMAN (SEQ ID NO:50).

Alignment segment 1/1: TABLE-US-00178 Quality: 3576.00 Escore: 0 Matching length: 363 Total length: 478 Matching Percent 100.00 Matching Percent Identity: 100.00 Similarity: Total Percent Similarity: 75.94 Total Percent Identity: 75.94 Gaps: 1

```
Alignment: TABLE-US-00179 ... 1
MAPLRPLLILALLAWVALADQESCKGRCTEGFNVDKKCQCDELCSYYQSC    50
                                                       1
|||||||||||||||||||||||||||||||||||||||||||||||||
MAPLRPLLILALLAWVALADQESCKGRCTEGFNVDKKCQCDELCSYYQSC    50    ... 51

CTDYTAECKPQVTRGDVFTMPEDEYTVYDDGEEKNNATVHEQVGGPSLTS    100
                                                       51
|||||||||||||||||||||||||||||||||||||||||||||||||
CTDYTAECKPQVTRGDVFTMPEDEYTVYDDGEEKNNATVHEQVGGPSLTS    100   ... 101

DLQAQSKGNPEQTPVLKPEEEAPAPEVGASKPEGIDSRPETLHPGRPQPP    150
                                                       101
|||||||||||||||||||||||||||||||||||||||||||||||||
DLQAQSKGNPEQTPVLKPEEEAPAPEVGASKPEGIDSRPETLHPGRPQPP    150   ... 151

AEEELCSGKPFDAFTDLKNGSLFAFRGQYCYELDEKAVRPGYPKLIRDVW    200
                                                       151
|||||||||||||||||||||||||||||||||||||||||||||||||
AEEELCSGKPFDAFTDLKNGSLFAFRGQYCYELDEKAVRPGYPKLIRDVW    200   ... 201

GIEGPIDAAFTRINCQGKTYLFKGSQYWRFEDGVLDPDYPRNISDGFDGI    250
                                                       201
|||||||||||||||||| ||||||||||||||||||||||||||||||
GIEGPIDAAFTRTNCQGKTYLFKGSQYWRFEDGVLDPDYPRNISDGFDGI    250   ... 251

PDNVDAALALPAHSYSGRERVYFFKGKQYWEYQFQHQPSQEECEGSSLSA    300
                                                       251
|||||||||||||||||||||||||||||||||||||||||||||||||
PDNVDAALALPAHSYSGRERVYFFKGKQYWEYQFQHQPSQEECEGSSLSA    300   ... 301

VFEHFAMMQRDSWEDIFELLFWGRTS........................    326
                                                       301
|||||||||||||||||||||||||||
VFEHFAMMQRDSWEDIFELLFWGRTSAGTRQPQFISRDWHGVPGQVDAAM    350   ... 326

..................................................    326  351
AGRIYISGMAPRPSLAKKQRFRHRNRKGYRSQRGHSRGRNQNSRRPSRAT    400   ... 327
```

-continued

```
........................................DKYYRVNLR  335
||||||||                                            401
WLSLFSSEESNLGANNYDDYRMDWLVPATCEPIQSVFFFSGDKYYRVNLR  450 ... 336

TRRVDTVDPPYPRSIAQYWLGCPAPGHL                        363
||||||||||||||||||||||||||||                        451
TRRVDTVDPPYPRSIAQYWLGCPAPGHL                        478
```

Sequence name: /tmp/jvp1VtnxNy/wxNSeFVZZw: Q9BSH7

Sequence documentation:

Alignment of: T39971_P11 (SEQ ID NO:53).times.Q9BSH7

Alignment segment 1/1: TABLE-US-00180 Quality: 3576.00 Escore: 0 Matching length: 363 Total length: 478 Matching Percent 100.00 Matching Percent Identity: 100.00 Similarity: Total Percent Similarity: 75.94 Total Percent Identity: 75.94 Gaps: 1

Sequence name: /tmp/fgebv7ir4i/48bTBMziJ0: VTNC_HUMAN (SEQ ID NO:50)

Sequence documentation:

Alignment of: T39971_P12 (SEQ ID NO:54).times.VTNC_HUMAN (SEQ ID NO:50).

Alignment segment 1/1: TABLE-US-00182 Quality: 2237.00 Escore: 0 Matching length: 223 Total length: 223

```
Alignment: TABLE-US-00181 ... 1
MAPLRPLLILALLAWVALADQESCKGRCTEGFNVDKKCQCDELCSYYQSC  50
||||||||||||||||||||||||||||||||||||||||||||||||||  1
MAPLRPLLILALLAWVALADQESCKGRCTEGFNVDKKCQCDELCSYYQSC  50 ... 51

CTDYTAECKPQVTRGDVFTMPEDEYTVYDDGEEKNNATVHEQVGGPSLTS  100
||||||||||||||||||||||||||||||||||||||||||||||||||  51
CTDYTAECKPQVTRGDVFTMPEDEYTVYDDGEEKNNATVHEQVGGPSLTS  100 ... 101

DLQAQSKGNPEQTPVLKPEEEAPAPEVGASKPEGIDSRPETLHPGRPQPP  150
||||||||||||||||||||||||||||||||||||||||||||||||||  101
DLQAQSKGNPEQTPVLKPEEEAPAPEVGASKPEGIDSRPETLHPGRPQPP  150 ... 151

AEEELCSGKPFDAFTDLKNGSLFAFRGQYCYELDEKAVRPGYPKLIRDVW  200
||||||||||||||||||||||||||||||||||||||||||||||||||  151
AEEELCSGKPFDAFTDLKNGSLFAFRGQYCYELDEKAVRPGYPKLIRDVW  200 ... 201

GIEGPIDAAFTRINCQGKTYLFKGSQYWRFEDGVLDPDYPRNISDGFDGI  250
||||||||||||||||||||||||||||||||||||||||||||||||||  201
GIEGPIDAAFTRINCQGKTYLFKGSQYWRFEDGVLDPDYPRNISDGFDGI  250 ... 251

PDNVDAALALPAHSYSGRERVYFFKGKQYWEYQFQHQPSQEECEGSSLSA  300
||||||||||||||||||||||||||||||||||||||||||||||||||  251
PDNVDAALALPAHSYSGRERVYFFKGKQYWEYQFQHQPSQEECEGSSLSA  300 ... 301

VFEHFAMMQRDSWEDIFELLFWGRTS.......................  326
|||||||||||||||||||||||||||                          301
VFEHFAMMQRDSWEDIFELLFWGRTSAGTRQPQFISRDWHGVPGQVDAAM  350 ... 326

..................................................  326 351
AGRIYISGMAPRPSLAKKQRFRHRNRKGYRSQRGHSRGRNQSRRPSRAM  400 ... 327

........................................DKYYRVNLR  335
||||||||                                            401
WLSLFSSEESNLGANNYDDYRMDWLVPATCEPIQSVFFFSGDKYYRVNLR  450 ... 336

TRRVDTVDPPYPRSIAQYWLGCPAPGHL                        363
||||||||||||||||||||||||||||                        451
TRRVDTVDPPYPRSIAQYWLGCPAPGHL                        478
```

Matching Percent 100.00 Matching Percent Identity: 100.00 Similarity: Total Percent Similarity: 100.00 Total Percent Identity: 100.00 Gaps: 0

```
Alignment: TABLE-US-00183 ... 1
MAPLRPLLILALLAWVALADQESCKGRCTEGFNVDKKCQCDELCSYYQSC  50
||||||||||||||||||||||||||||||||||||||||||||||||||  1
MAPLRPLLILALLAWVALADQESCKGRCTEGFNVDKKCQCDELCSYYQSC  50 ... 51

CTDYTAECKPQVTRGDVFTMPEDEYTVYDDGEEKNNATVHEQVGGPSLTS  100
```

```
                                            -continued
|||||||||||||||||||||||||||||||||||||||||||||||||  51
CTDYTAECKPQVTRGDVFTMPEDEYTVYDDGEEKNNATVHEQVGGPSLTS  100  . . . 101

DLQAQSKGNPEQTPVLKPEEEAPAPEVGASKPEGIDSRPETLHPGRPQPP  150
||||||||||||||||||||||||||||||||||||||||||||||||||  101
DLQAQSKGNPEQTPVLKPEEEAPAPEVGASKPEGIDSRPETLHPGRPQPP  150  . . . 151

AEEELCSGKPFDAFTDLKNGSLFAFRGQYCYELDEKAVRPGYPKLIRDVW  200
||||||||||||||||||||||||||||||||||||||||||||||||||  151
AEEELCSGKPFDAFTDLKNGSLFAFRGQYCYELDEKAVRPGYPKLIRDVW  200  . . . 201

GIEGPIDAAFTRINCQGKTYLFK                             223
|||||||||||||||||||||||                             201
GIEGPIDAAFTRINCQGKTYLFK                             223
```

Sequence name: /tmp/fgebv7ir4i/48bTBMziJ0:Q9BSH7
Sequence documentation:
Alignment of: T39971_P12 (SEQ ID NO:54).times. Q9BSH7
Alignment segment 1/1: TABLE-US-00184 Quality: 2237.00 Escore: 0 Matching length: 223 Total length: 223 Matching Percent 100.00 Matching Percent Identity: 100.00 Similarity: Total Percent Similarity: 100.00 Total Percent Identity: 100.00 Gaps: 0

```
Alignment: TABLE-US-00185 . . . 1
MAPLRPLLILALLAWVALADQESCKGRCTEGFNVDKKCQCDELCSYYQSC   50
||||||||||||||||||||||||||||||||||||||||||||||||||   1
MAPLRPLLILALLAWVALADQESCKGRCTEGFNVDKKCQCDELCSYYQSC   50  . . . 51

CTDYTAECKPQVTRGDVFTMPEDEYTVYDDGEEKNNATVHEQVGGPSLTS  100
||||||||||||||||||||||||||||||||||||||||||||||||||  51
CTDYTAECKPQVTRGDVFTMPEDEYTVYDDGEEKNNATVHEQVGGPSLTS  100  . . . 101

DLQAQSKGNPEQTPVLKPEEEAPAPEVGASKPEGIDSRPETLHPGRPQPP  150
||||||||||||||||||||||||||||||||||||||||||||||||||  101
DLQAQSKGNPEQTPVLKPEEEAPAPEVGASKPEGIDSRPETLHPGRPQPP  150  . . . 151

AEEELCSGKPFDAFTDLKNGSLFAFRGQYCYELDEKAVRPGYPKLIRDVW  200
||||||||||||||||||||||||||||||||||||||||||||||||||  151
AEEELCSGKPFDAFTDLKNGSLFAFRGQYCYELDEKAVRPGYPKLIRDVW  200  . . . 201

GIEGPIDAAFTRINCQGKTYLFK                             223
|||||||||||||||||||||||                             201
GIEGPIDAAFTRINCQGKTYLFK                             223
```

Expression of VTNC_HUMAN Vitronectin (Serum Spreading Factor, Somatomedin B, Complement S-Protein) T39971 Transcripts, which are Detectable by Amplicon as Depicted in Sequence Name T39971 junc23-33 (SEQ ID NO:836) in Normal and Cancerous Breast Tissues Expression of VTNC_HUMAN vitronectin (serum spreading factor, somatomedin B, complement S-protein) transcripts detectable by or according to junc23-33, T39971 junc23-33 amplicon (SEQ ID NO:836) and T39971 junc23-33F (SEQ ID NO:834) and T39971 junc23-33R (SEQ ID NO:835) primers was measured by real time PCR. In parallel the expression of four housekeeping genes--PBGD (GenBank Accession No. BC019323 (SEQ ID NO:926); amplicon—PBGD-amplicon (SEQ ID NO:929), HPRT1 (GenBank Accession No. NM.sub.--000194 (SEQ ID NO:930); amplicon--HPRT1-amplicon (SEQ ID NO:933)), SDHA (GenBank Accession No. NM.sub.--004168 (SEQ ID NO:922); amplicon--SDHA-amplicon (SEQ ID NO:925)), and G6PD (GenBank Accession No. NM.sub.--000402 (SEQ ID NO:918); G6PD-amplicon (SEQ ID NO:921)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 1, above, "Tissue samples in testing panel"), to obtain a value of fold differetial expression for each sample relative to median of the normal PM samples.

Figure 10:
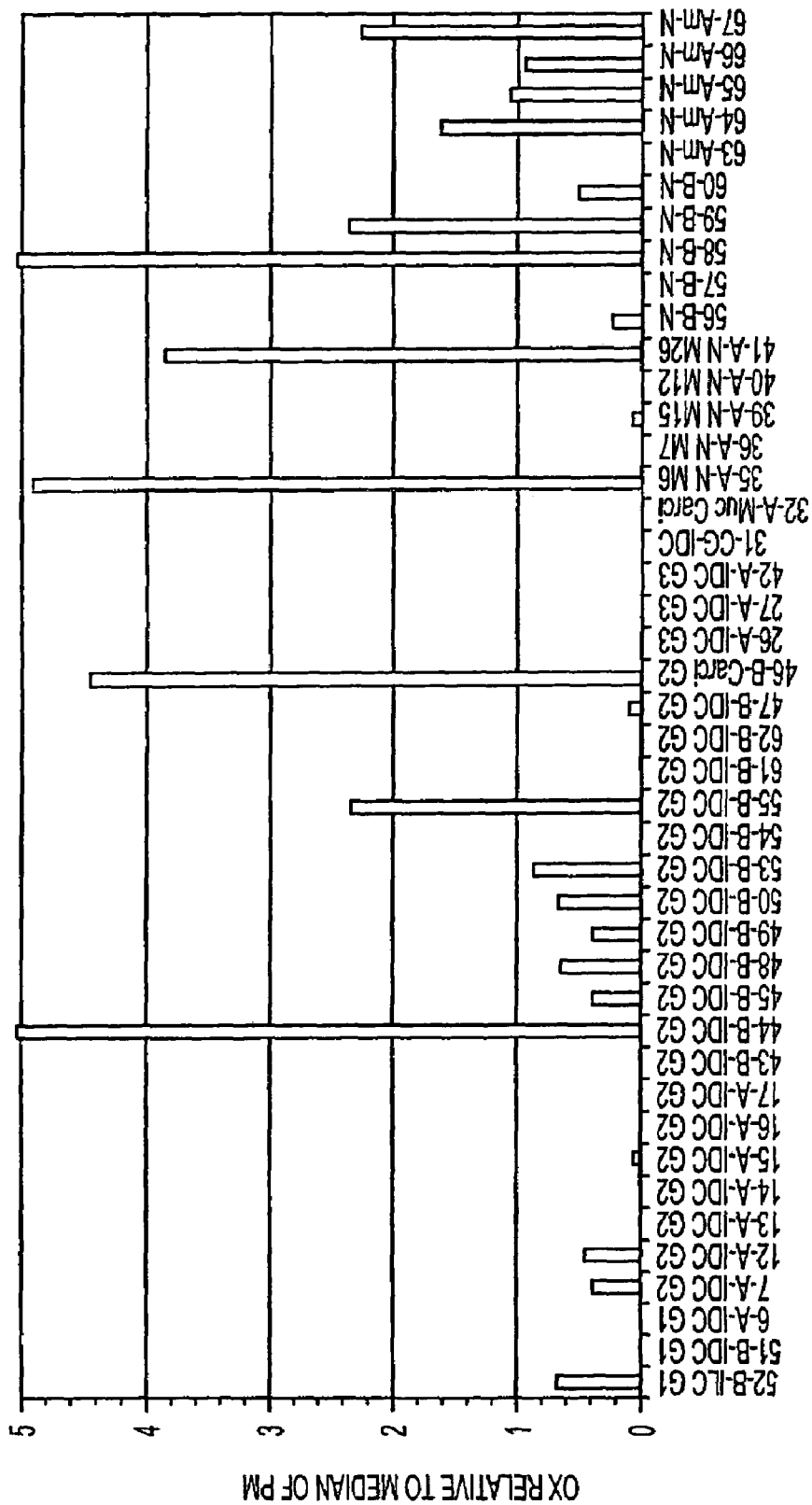
FIG. 10 is a histogram showing the expression of VTNC_HUMAN vitronectin (serum spreading factor, somatomedin B, complement S-protein) T39971 transcripts, which are detectable by amplicon as depicted in sequence name T39971 junc23-33 (SEQ ID NO:836) in normal and cancerous breast tissues.

FIG. 10 is a histogram showing down regulation of the above-indicated VTNC_HUMAN vitronectin (serum spreading factor, somatomedin B, complement S-protein) transcripts in cancerous breast samples relative to the normal samples.

As is evident from FIG. 10, the expression of VTNC_HUMAN vitronectin (serum spreading factor, somatomedin B, complement S-protein) transcripts detectable by the above amplicon in cancer samples was significantly lower than in the non-cancerous samples (Sample Nos. 56-60, 63-67 Table 1, "Tissue samples in testing panel").

Primer pairs are also optionally and preferably encompassed within the present invention; for example, for the above experiment, the following primer pair was used as a non-limiting illustrative example only of a suitable primer pair: T39971 junc23-33F (SEQ ID NO:834) forward primer; and T39971 junc23-33R (SEQ ID NO:835) reverse primer.

The present invention also preferably encompasses any amplicon obtained through the use of any suitable primer pair; for example, for the above experiment, the following amplicon was obtained as a non-limiting illustrative example only of a suitable amplicon: T39971 junc23-33 (SEQ ID NO:836). TABLE-US-00186

```
T39971junc22-33F (SEQ ID NO: 834):
GGGGCAGAACCTCTGACAAG

T39971junc22-33R (SEQ ID NO: 835):
GGGCAGCCCAGCCAGTA

T39971junc22-33 amplicon (SEQ ID NO: 836):
GGGGCAGAACCTCTGACAAGTACTACCGAGTCAATCTTCGCACACGGCGA
GTGGACACTGTGGACCCTCCCTACCCACGCTCCATCGCTCAGTACTGGCT
GGGCTGCCC
```

Expression of VTNC_HUMAN Vitronectin (Serum Spreading Factor, Somatomedin B, Complement S-Protein), Antisense to SARM1 (T23434), T39971 Transcripts which are Detectable by Amplicon as Depicted in Sequence Name T39971junc23-33 (SEQ ID NO:836) in Different Normal Tissues Expression of VTNC_HUMAN vitronectin (serum spreading factor, somatomedin B, complement S-protein), transcripts detectable by or according to T39971junc23-33 amplicon (SEQ ID NO:836) and T39971junc23-33F (SEQ ID NO:834) and T39971junc23-33R (SEQ ID NO:835) was measured by real time PCR. In parallel the expression of four housekeeping genes-RPL19 (GenBankAccession No. NM.sub.--000981 (SEQ ID NO:934); RPL19 amplicon (SEQ ID NO:937)), TATA box (GenBank Accession No. NM.sub.--003194 (SEQ ID NO:938); TATAamplicon (SEQ ID NO:941)), UBC (GenBank Accession No. BC000449 (SEQ ID NO:942); amplicon--Ubiquitin-amplicon (SEQ ID NO:945)) and SDHA (GenBank Accession No. NM.sub.--004168 (SEQ ID NO:922); amplicon--SDHA-amplicon (SEQ ID NO:925)) was measured similarly. For each RT sample, the expression of the above amplicon was normalized to the geometric mean of the quantities of the housekeeping genes. The normalized quantity of each RT sample was then divided by the median of the quantities of the breast samples (Sample Nos. 33-35, Table 2, "Tissue samples in normal panel" above), to obtain a value of relative expression of each sample relative to median of the breast samples. Primers and amplicon are as above.

Figure 11:
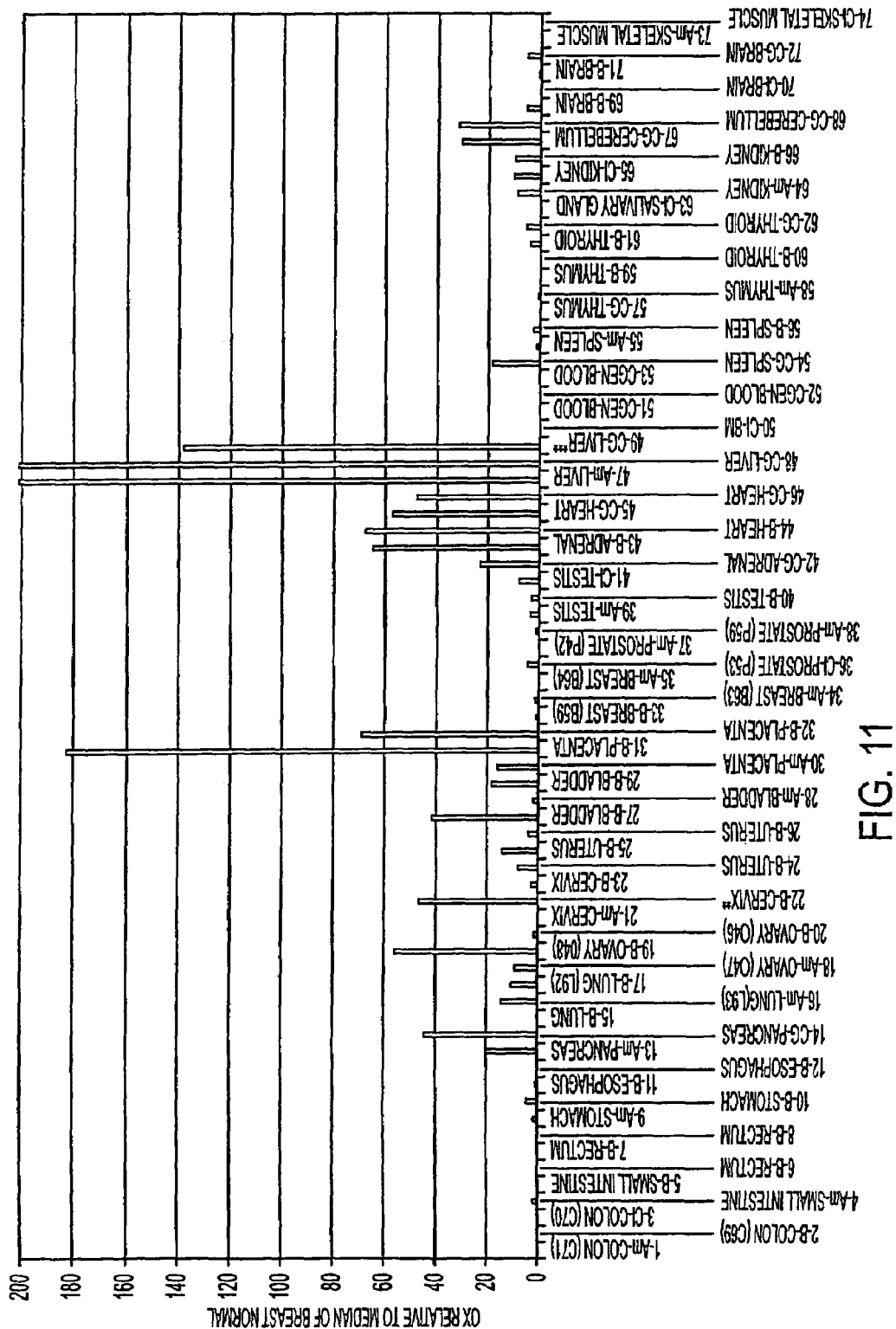
FIG. 11 is a histogram showing the expression of VTNC_HUMAN vitronectin (serum spreading factor, somatomedin B, complement S-protein), antisense to SARM1 (T23434), T39971 transcripts, which are detectable by amplicon as depicted in sequence name T39971junc23-33, in different normal tissues.

The results are presented in FIG. 11, demonstrating the expression of VTNC_HUMAN vitronectin (serum spreading factor, somatomedin B, complement S-protein), antisense to SARM1 (T23434), T39971 transcripts, which are detectable by amplicon as depicted in sequence name T39971junc23-33 (SEQ ID NO:836), in different normal tissues.

Expression of VTNC_HUMAN Vitronectin (Serum Spreading Factor, Somatomedin B, Complement S-Protein) T39971 Transcripts which are Detectable by Amplicon as Depicted in Sequence Name T39971 Seg22 (SEQ ID NO:839) in Normal and Cancerous Breast Tissues Expression of VTNC_HUMAN vitronectin (serum spreading factor, somatomedin B, complement S-protein) transcripts detectable by or according to seg22, T39971 seg22 (SEQ ID NO:839) amplicon(s) and primers T39971 seg22F (SEQ ID NO:837) and T39971 seg22R (SEQ ID NO:838) was measured by real time PCR. In parallel the expression of four housekeeping genes-PBGD (GenBank Accession No. BC019323 (SEQ ID NO:926); amplicon--PBGD-amplicon (SEQ ID NO:929)), HPRT1 (GenBankAccession No. NM.sub.--000194 (SEQ ID NO:930); amplicon--HPRT1-amplicon (SEQ ID NO:933)), SDHA (GenBank Accession No. NM.sub.--004168 (SEQ ID NO:922); amplicon--SDHA-amplicon (SEQ ID NO:925)); G6PD (GenBank Accession No. NM.sub.--000402 (SEQ ID NO:918); G6PD-amplicon (SEQ ID NO:921)), was measured similarly. For each RT sample, the expression of the above amplicon was normalized to the geometric mean of the quantities of the housekeeping genes. The normalized quantity of each RT sample was then divided by the median of the quantities of the normal postmortem (PM) samples (Sample Nos. 56-60, 63-67, Table 1: Tissue samples in testing panel, above), to obtain a value of fold differential expression for each sample relative to median of the normal PM samples.

In one experiment that was carried out no differential expression in the cancerous samples relative to the normal PM samples was observed. However, this may be due to a problem that is specific to this particular experiment.

Primer pairs are also optionally and preferably encompassed within the present invention; for example, for the above experiment, the following primer pair was used as a non-limiting illustrative example only of a suitable primer pair: T39971 seg22F (SEQ ID NO:837) forward primer; and T39971 seg22R (SEQ ID NO:838) reverse primer.

The present invention also preferably encompasses any amplicon obtained through the use of any suitable primer pair; for example, for the above experiment, the following amplicon was obtained as a non-limiting illustrative example only of a suitable amplicon: T39971 seg22 (SEQ ID NO:839). TABLE-US-00187 Forward primer T39971 seg22F: (SEQ ID NO: 837) GCAGTCTTGGATTC-CTTTCACATT Reverse primer T39971 seg22R: (SEQ ID NO: 838) GAGGCTGTTGAAGTTAGGATCTCC Amplicon T39971 seg22: (SEQ ID NO: 839) GCAGTCTTGGATTC-CTTTCACATTTCACTGGGGACAGGCCT-CAGCATGTGCCCACCC CTGACCCCCACCTCAT-GCTGGGAGATCCTMCTTCAACAGCCTC Description for Cluster Z21368

Cluster Z21368 features 7 transcript(s) and 34 segment(s) of interest, the names for which are given in Tables 1 and 2, respectively, the sequences themselves are given at the end of the application. The selected protein variants are given in table 3. TABLE-US-00188 TABLE 1 Transcripts of interest Transcript Name Sequence ID No. Z21368_PEA_1_T10 55 Z21368_PEA_1_T11 56 Z21368_PEA_1_T23 57 Z21368_PEA_1_T24 58 Z21368_PEA_1_T5 59 Z21368_PEA_1_T6 60 Z21368_PEA_1_T9 61

TABLE-US-00189 TABLE 2 Segments of interest Segment Name Sequence ID No. Z21368_PEA_1_node_0 62 Z21368_PEA_1_node_15 63 Z21368_PEA_1_node_19 64 Z21368_PEA_1_node_2 65 Z21368_PEA_1_node_21 66 Z21368_PEA_1_node_33 67 Z21368_PEA_1_node_36 68 Z21368_PEA_1_node_37 69 Z21368_PEA_1_node_39 70 Z21368_PEA_1_node_4 71 Z21368_PEA_1_node_41 72 Z21368_PEA_1_node_43 73 Z21368_PEA_1_node_45 74 Z21368_PEA_1_node_53 75 Z21368_PEA_1_node_56 76 Z21368_PEA_1_node_58 77 Z21368_PEA_1_node_66 78 Z21368_PEA_1_node_67 79 Z21368_PEA_1_node_69 80 Z21368_PEA_1_node_11 81 Z21368_PEA_1_node_12 82 Z21368_PEA_1_node_16 83 Z21368_PEA_1_node_17 84 Z21368_PEA_1_node_23 85 Z21368_PEA_1_node_24 86 Z21368_PEA_1_node_30 87 Z21368_PEA_1_node_31 88 Z21368_PEA_1_node_38 89 Z21368_PEA_1_node_47 90 Z21368_PEA_1_node_49 91 Z21368_PEA_1_node_51 92 Z21368_PEA_1_node_61 93 Z21368_PEA_1_node_68 94 Z21368_PEA_1_node_7 95

TABLE-US-00190 TABLE 3 Proteins of interest Protein Name Sequence ID No. Z21368_PEA_1_P2 97

Z21368_PEA_1_P5 98 Z21368_PEA_1_PEA15 99
Z21368_PEA_1_P16 100 Z21368_PEA_1_P22 101
Z21368_PEA_1_P23 102

These sequences are variants of the known protein Extracellular sulfatase Sulf-1 precursor (SwissProt accession identifier SUL1_HUMAN; known also according to the synonyms EC 3.1.6.-; HSulf-1), SEQ ID NO:96, referred to herein as the previously known protein.

Protein Extracellular sulfatase Sulf-1 precursor (SEQ ID NO:96) is known or believed to have the following function(s): Exhibits arylsulfatase activity and highly specific endoglucosamine-6-sulfatase activity. It can remove sulfate from the C-6 position of glucosamine within specific subregions of intact heparin. Diminishes HSPG (heparan sulfate proteoglycans) sulfation, inhibits signaling by heparin-dependent growth factors, diminishes proliferation, and facilitates apoptosis in response to exogenous stimulation. The sequence for protein Extracellular sulfatase Sulf-1 precursor is given at the end of the application, as "Extracellular sulfatase Sulf-1 precursor amino acid sequence" (SEQ ID NO:96). Known polymorphisms for this sequence are as shown in Table 4. TABLE-US-00191 TABLE 4 Amino acid mutations for Known Protein SNP position(s) on amino acid sequence Comment 87-88 CC→AA: LOSS OF ARYLSULFATASE ACTIVITY AND LOSS OF ABILITY TO MODULATE APOPTOSIS. 49 L→P 728 K→R Protein Extracellular sulfatase Sulf-1 precursor (SEQ ID NO:96) localization is believed to be Endoplasmic reticulum and Golgi stack; also localized on the cell surface (By similarity).

The following GO Annotation(s) apply to the previously known protein. The following annotation(s) were found: apoptosis; metabolism; heparan sulfate proteoglycan metabolism, which are annotation(s) related to Biological Process; arylsulfatase; hydrolase, which are annotation(s) related to Molecular Function; and extracellular space; endoplasmic reticulum; Golgi apparatus, which are annotation(s) related to Cellular Component.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster Z21368 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 12 refer to weighted expression of ESTs in each category, as "parts per million" (ratio of the expression of ESTs for a particular cluster to the expression of all ESTs in that category, according to parts per million).

Figure 12:
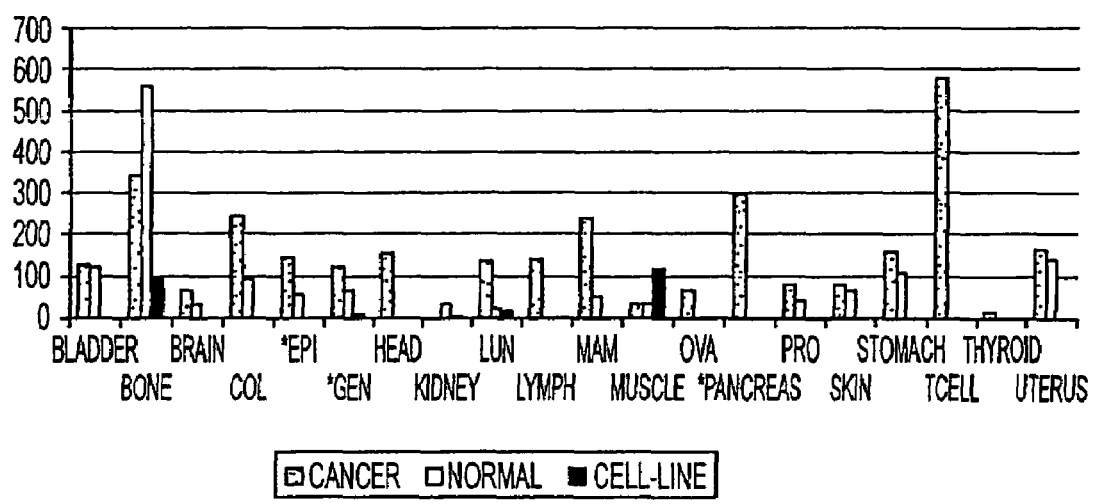
FIG. 12 is a histogram showing Cancer and cell-line vs. normal tissue expression for Cluster Z21368, demonstrating overexpression in epithelial malignant tumors, a mixture of malignant tumors from different tissues and pancreas carcinoma.

Overall, the following results were obtained as shown with regard to the histograms in FIG. 12 and Table 5. This cluster is overexpressed (at least at a minimum level) in the following pathological conditions: epithelial malignant tumors, a mixture of malignant tumors from different tissues and pancreas carcinoma. TABLE-US-00192 TABLE 5 Normal tissue distribution Name of Tissue Number bladder 123 Bone 557 Brain 34 Colon 94 epithelial 56 general 68 head and neck 0 kidney 35 Lung 22 lymph nodes 0 breast 52 muscle 31 ovary 0 pancreas 0 prostate 44 skin 67 stomach 109 T cells 0 Thyroid 0 uterus 140

TABLE-US-00193 TABLE 6 P values and ratios for expression in cancerous tissue Name of Tissue P1 P2 SP1 R3 SP2 R4 bladder 5.4e-01 6.6e-01 6.4e-01 1.0 8.5e-01 0.7 bone 4.5e-01 8.2e-01 9.1e-01 0.4 1 0.3 brain 5.5e-01 7.3e-01 1.5e-01 1.5 5.0e-01 0.9 colon 1.4e-01 2.8e-01 1.0e-01 2.0 3.0e-01 1.4 epithelial 1.1e-03 1.5e-01 1.2e-07 2.1 1.0e-01 1.1 general 1.4e-05 5.3e-02 1.9e-06 1.6 6.7e-01 0.8 head and neck 2.4e-02 7.1e-02 4.6e-01 2.5 7.5e-01 1.4 kidney 8.9e-01 9.0e-01 1 0.4 1 0.4 lung 3.5e-01 4.1e-01 7.2e-03 2.6 1.0e-01 1.6 lymph nodes 7.7e-02 3.1e-01 2.3e-02 8.5 1.9e-01 3.2 breast 4.0e-01 6.1e-01 5.4e-02 2.3 3.0e-01 1.3 muscle 7.5e-02 3.5e-02 1 1.0 1.7e-01 1.7 ovary 3.8e-01 4.2e-01 2.2e-01 2.9 3.4e-01 2.2 pancreas 2.2e-02 6.9e-02 1.4e-08 6.5 1.4e-06 4.6 prostate 8.3e-01 8.9e-01 3.1e-01 1.4 5.2e-01 1.1 skin 6.1e-01 8.1e-01 6.0e-01 1.2 1 0.3 stomach 4.4e-02 5.0e-01 5.0e-01 0.8 9.7e-01 0.4 T cells 5.0e-01 6.7e-01 3.3e-01 3.1 7.2e-01 1.4 Thyroid 3.6e-01 3.6e-01 1 1.1 1 1.1 uterus 3.5e-01 7.8e-01 4.6e-01 0.9 9.1e-01 0.5

As noted above, cluster Z21368 features 7 transcript(s), which were listed in Table 1 above. These transcript(s) encode for protein(s) which are variant(s) of protein Extracellular sulfatase Sulf-1 precursor (SEQ ID NO:96). A description of each variant protein according to the present invention is now provided.

Variant protein Z21368_PEA.sub.--1_P2 (SEQ ID NO:97) according to the present invention has an amino acid sequence as given at the end of the application; it is encoded by transcript(s) Z21368_PEA.sub.--1_T5 (SEQ ID NO:59). An alignment is given to the known protein (Extracellular sulfatase Sulf-1 precursor (SEQ ID NO:96) at the end of the application. One or more alignments to one or more previously published protein sequences are given at the end of the application. A brief description of the relationship of the variant protein according to the present invention to each such aligned protein is as follows:

Comparison report between Z21368_PEA.sub.--1_P2 (SEQ ID NO:97) and SUL1_HUMAN (SEQ ID NO:96):

1. An isolated chimeric polypeptide encoding for Z21368_PEA.sub.--1_P2 (SEQ ID NO:97), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSVV QAM-HEPRTFAVYLNNTGYRTAFFGKYLNEY-NGSYIPPGWREWLGLIKNSRFYNYTVCR NGIKEKHGFDYAKDYFTDLITNESINY-FKMSKRMYPHRPVMMVISHMPHGPEDSAPQ FSKLYPNASQHITPSYNYAPNMDKHWIM-QYTGPMLPIHMEFTNILQRKRLQTLMSVDD SVER-LYNMLVETGELENTYIIYTADHGY-HIGQFGLVKGKSMPYDFDIRVPFFIRGPSVEP GSIVPQIVLNIDLAPTILDIAGLDTPPD-VDGKSVLKLLDPEKPGNRFRTNKKAKIWRDTFL VERGKFLRKKEESSKNIQQSNHLPKY-ERVKELCQQARYQTACEQPGQKWQCIEDTSGK LRI-HKCKGPSDLLTVRQSTRNLYARGFHDKD-KECSCRESGYRASRSQRKSQRQFLRNO GTPKYKPRFVHTRQTRSLSVEFEGEIY-DINLEEEEELQVLQPRNIAKRHDEGHKGPRDLQ ASSGGNRGRMLADSSNAVGPPTTVRVTH-KCFILPNDSIHCERELYQSARAWKDHKAYI DKEIEALQDKIKNLREVRGHLKRRK-PEECSCSKQSYYNKEKGVKKQEKLKSHLHPFKE AAQEVDSKLQLFKENNRRRK-KERKEKRRQRKGEECSLPGLTCFTHDN-NHWQTAPFWN corresponding to amino acids 1-761 of SUL1_HUMAN (SEQ ID NO:96), which also corresponds to amino acids 1-761 of Z21368_PEA.sub.--1_P2 (SEQ ID NO:97), and a second amino acid sequence being at least 70%, optionally at least 80%, preferably at least 85%, more preferably at least 90% and most preferably at least 95% homologous to a polypeptide having the sequence PHKYSAHGRTRHFESATRTTNGAQKLSRI (SEQ ID NO:1005) corresponding to amino acids 762-790 of Z21368_PEA.sub.--1_P2 (SEQ ID NO:97), wherein said first and second amino acid sequences are contiguous and in a sequential order.

2. An isolated polypeptide encoding for a tail of Z21368_PEA.sub.--1_P2 (SEQ ID NO:97), comprising a polypeptide being at least 70%, optionally at least about 80%, preferably at least about 85%, more preferably at least about 90% and most preferably at least about 95% homologous to the sequence PHKYSAHGRTRHFESATRTTNGAQKLSRI (SEQ ID NO:1005) in Z21368_PEA.sub.--1_P2 (SEQ ID NO:97).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA.sub.--1_P2 (SEQ ID NO:97) is encoded by the following transcript(s): Z21368_PEA.sub.--1_T5 (SEQ ID NO:59), for which the sequence(s) is/are given at the end of the application. The coding portion of transcript Z21368_PEA.sub.--1_T5 (SEQ ID NO:59) is shown in bold; this coding portion starts at position 529 and ends at position 2898.

Variant protein Z21368_PEA.sub.--1_P5 (SEQ ID NO:98) according to the present invention has an amino acid sequence as given at the end of the application; it is encoded by transcript(s) Z21368_PEA.sub.--1_T9 (SEQ ID NO:61). An alignment is given to the known protein (Extracellular sulfatase Sulf-1 precursor (SEQ ID NO:96)) at the end of the application. One or more alignments to one or more previously published protein sequences are given at the end of the application. A brief description of the relationship of the variant protein according to the present invention to each such aligned protein is as follows:

Comparison report between Z21368_PEA.sub.--1_P5 (SEQ ID NO:98) and Q7Z2W2 (SEQ ID NO:840) (SEQ ID NO:840):

1. An isolated chimeric polypeptide encoding for Z21368_PEA.sub.--1_P5 (SEQ ID NO:98), comprising a first amino acid sequence being at least 90% homologous to MKYSCCALVLAVLGTELLGSLCSTVR-SPRFRGRIQQERKNIRPNIILVLTDDQDVEL corresponding to amino acids 1-57 of Q7Z2W2 (SEQ ID NO:840), which also corresponds to amino acids 1-57 of Z21368_PEA.sub.--1_P5 (SEQ ID NO:98), second bridging amino acid sequence comprising A, and a third amino acid sequence being at least 90% homologous to FFGKYLNEY-NGSYIPPGWREWLGLIKNSRFYNY-TVCRNGIKEKHGFDYAKDYFTDLITN ESINYFKM-SKRMYPHRPVMMVISHAAPHGPEDSAPQFSKLYPN ASQHITPSYNYAPNM DKHWIMQYTGPMLPIHMEFT-NILQRKRLQTLMSVDDSVERLYNMLVET-GELENTYIIYT ADHGYHIGQFGLVKGKSMPYD-FDIRVPFFIRGPSVEPGSIVPQIVLNIDLAPTILDIAGLDT PPDVGKSVLKLLDPEKPGNRFRT-NKKAKIWRDTFLVERGKFLRKKEESSKNIQQSNHL PKYERVKELCQQARYQTACEQPGQK-WQCIEDTSGKLRIHKCKGPSDLLTVRQSTRNLY ARG-FHDKDKECSCRESGYRASRSQRKSQRQ-FLRNOGTPKYKPRFVHTRQTRSLSVEFE GEIYDINLEEEEELQVLQPRNIAKRHDE-GHKGPRDLQASSGGNRGRMLADSSNAVGPPT TVRVTHKCFILPNDSIHCERELYQSA-RAWKDHKAYIDKEIEALQDKIKNLREVRGHLKR RKPEECSCSKQSYYNKEKGVKKQEKLK-SHLHPFKEMQEVDSKLQLFKENNRRRKKER KEKRRQRKGEECSLPGLTCFTHDN-NHWQTAPFWNLGSFCACTSSNNNTYWCLRTVNE THNFLFCEFATGFLEYFDMNTDPYQLT-NTVHTVERGILNOLHVQLMELRSCQGYKQCN PRP-KNLDVGNKDGGSYDLHRGQLWDGWEG corresponding to amino acids 139-871 of Q7Z2W2 (SEQ ID NO:840), which also corresponds to amino acids 59-791 of Z21368_PEA.sub.--1_P5 (SEQ ID NO:98), wherein said first, second and third amino acid sequences are contiguous and in a sequential order.

2. An isolated polypeptide encoding for an edge portion of Z21368_PEA.sub.--1_P5 (SEQ ID NO:98), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least three amino acids comprise LAF having a structure as follows (numbering according to Z21368_PEA.sub.--1_P5 (SEQ ID NO:98)): a sequence starting from any of amino acid numbers 57-x to 57; and ending at any of amino acid numbers 59+((n−2)-x), in which x varies from 0 to n−2.

Comparison report between Z21368_PEA.sub.--1_P5 (SEQ ID NO:98) and MH12997 (SEQ ID NO:841) (SEQ ID NO:841):

1. An isolated chimeric polypeptide encoding for Z21368_PEA.sub.--1_P5 (SEQ ID NO:98), comprising a first amino acid sequence being at least 70%, optionally at least 80%, preferably at least 85%, more preferably at least 90% and most preferably at least 95% homologous to a polypeptide having the sequence MKYSCCALVLAVLG-TELLGSLCSTVRSPRFRGRIQQQERKNIR-PNIILVLTDDQDVELAFF GKYLNEYNGSYIPPG-WREWLGLIKNSRFYNYTVCRNGIKEKHGFDYAKDY FTDLITNES INYFKMSKRMYPHRPVMMVISHMPHG-PEDSAPQFSKLYPNASQHITPSYNYAPNMDK HWIM-QYTGPMLPIHMEFTNILQRKRLQTLMS-VDDSVERLYNMLVETGELENTYIIYTAD HGYHIGQFGLVKGKSMPYD-FDIRVPFFIRGPSVEPGSIVPQIVLNID-LAPTILDIAGLDTPP DVDGKSVLKLLDPEKPGNRFRT-NKKAKIWRDTFLVERGKFLRKKEESSKNIQQSNHLP KYERVKELCQQARYQTACEQPGQK-WQCIEDTSGKLRIHKCKGPSDLLTVRQSTRNLYA RGFHDKDKECSCRESGYRASRSQRK-SQRQFLRNOGTPKYKPRFVHTRQTRSLSVEFEGE IYDINLEEEEELQVLQPRNIAKRHDEGH-KGPRDLQASSGGNRGRMLADSSNAVGPPTTV RVTH-KCFILPNDSIHCERELYQSARAWKDH-KAYIDKEIEALQDKIKNLREVRGHLKRRK PEECSCSKQSYYNKEKGVKKQEKLKSHL-HPFKEMQEVDSKLQLFKENNRRRKKERKE KRRQRKGEECSLPGLTCFTHDN-NHWQTAPFWNLGSFCACTSSNNNTYWCLRTVNETH NFLFCEFATGFLEYFDMNTDPYQLT-NTVHTVERGILNOLHVQLME (SEQ ID NO:1006) corresponding to amino acids 1-751 of Z21368_PEA.sub.--1_P5 (SEQ ID NO:98), and a second amino acid sequence being at least 90% homologous to LRSCQGYKQCNPRPKNLD- VGNKDGGSYDLHRGQLWDGWEG corresponding to amino acids 1-40 of AAH12997 (SEQ ID NO:841), which also corresponds to amino acids 752-791 of Z21368_PEA.sub.--1_P5 (SEQ ID NO:98), wherein said first and second amino acid sequences are contiguous and in a sequential order.

2. An isolated polypeptide encoding for a head of Z21368_PEA.sub.--1_P5 (SEQ ID NO:98), comprising a polypeptide being at least 70%, optionally at least about 80%, preferably at least about 85%, more preferably at least about 90% and most preferably at least about 95% homologous to the sequence TABLE-US-00194

```
                                              (SEQ ID NO: 1006)
MKYSCCALVLAVLGTELLGSLCSTVRSPRFRGRIQQERKNIRPNIILVLT
DDQDVELAFF (SEQ ID NO: 98)
GKYLNEYNGSYIPPGWREWLGLIKNSRFYNYTVCRNGIKEKHGFDYAKDY
FTDLITNESINYFKMSKRMYPHRPVMMVISHAAPHGPEDSAPQFSKLYPN
ASQHITPSYNYAPNMDKHWIMQYTGPMLPIHMEFTNILQRKRLQTLMSVD
DSVERLYNMLVETGELENTYIIYTADHGYHIGQFGLVKGKSMPYDFDIRV
PFFIRGPSVEPGSIVPQIVLNIDLAPTILDIAGLDTPPDVDGKSVLKLLD
PEKPGNRFRTNKKAKIWRDTFLVERGKFLRKKEESSKNIQQSNHLPKYER
VKELCQQARYQTACEQPGQKWQCIEDTSGKLRIHKCKGPSDLLTVRQSTR
NLYARGFHDKDKECSCRESGYRASRSQRKSQRQFLRNQGTPKYKPRFVHT
RQTRSLSVEFEGEIYDINLEEEEELQVLQPRNIAKRHDEGHKGPRDLQAS
SGGNRGRMLADSSNAVGPPTTVRVTHKCFILPNDSIHCERELYQSARAWK
DHKAYIDKEIEALQDKIKNLREVRGHLKRRKPEECSCSKQSYYNKEKGVK
KQEKLKSHLHPFKEAAQEVDSKLQLFKENNRRRKKERKEKRRQRKGEECS
LPGLTCFTHDNNHWQTAPFWNLGSFCACTSSNNNTYWCLRTVNETHNFLF
CEFATGFLEYFDMNTDPYQLTNTVHTVERGILNQLHVQLME of
Z21368_PEA_1_P5.
```

Comparison report between Z21368_PEA.sub.--1_P5 (SEQ ID NO:98) and SUL1_HUMAN (SEQ ID NO:96):

1. An isolated chimeric polypeptide encoding for Z21368_PEA.sub.--1_P5 (SEQ ID NO:98), comprising a first amino acid sequence being at least 90% homologous to MKYSCCALVLAVLGTELLGSLCSTVR-SPRFRGRIQQERKNIRPNIILVLTDDQDVEL corresponding to amino acids 1-57 of SUL1_HUMAN (SEQ ID NO:96), which also corresponds to amino acids 1-57 of Z21368_PEA.sub.--1_P5 (SEQ ID NO:98), and a second amino acid sequence being at least 90% homologous to AFF-GKYLNEYNGSYIPPGWREWLGLIKNSR-FYNYTVCRNGIKEKHGFDYAKDYFTDLIT NESINY-FKMSKRMYPHRPVMMVISHMPHGPEDSAPQFSKLY PNASQHITPSYNYAPN MDKHWIMQYTGPMLPIH-MEFTNILQRKRLQTLMSVDDSVERLYNM-LVETGELENTYII YTADHGYHIGQFGLVKGKSMPYD-FDIRVPFFIRGPSVEPGSIVPQIVLNIDLAPTILDIAGL DTPPDVDGKSVLKLLDPEKPGNRFRT-NKKAKIWRDTFLVERGKFLRKKEESSKNIQQSN HLP-KYERVKELCQQARYQTACEQPGQK-WQCIEDTSGKLRIHKCKGPSDLLTVRQSTRN LYARGFHDKDKECSCRESGYRASRSQRK-SQRQFLRNOGTPKYKPRFVHTRQTRSLSVE FEGEIY-DINLEEEEELQVLQPRNIAKRHDEGHKG-PRDLQASSGGNRGRMLADSSNAVGP PTTVRVTHKCFILPNDSIHCERELYQSA-RAWKDHKAYIDKEIEALQDKIKNLREVRGHL KRRK-PEECSCSKQSYYNKEKGVKKQEKLKSHL-HPFKEAAQEVDSKLQLFKENNRRRK KERKEKRRQRKGEECSLPGLTCFTHDN-NHWQTAPFWNLGSFCACTSSNNNTYWCLRT VNETHNFLFCEFATGFLEYFDMNTD-PYQLTNTVHTVERGILNOLHVQLMELRSCQGYK QCNPRPKNLDVGNKDGGSYDLHRGQLWDGWEG corresponding to amino acids 138-871 of SUL1_HUMAN (SEQ ID NO:96), which also corresponds to amino acids 58-791 of Z21368_PEA.sub.--1_P5 (SEQ ID NO:98), wherein said first and second amino acid sequences are contiguous and in a sequential order.

2. An isolated chimeric polypeptide encoding for an edge portion of Z21368_PEA.sub.--1_P5 (SEQ ID NO:98), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LA, having a structure as follows: a sequence starting from any of amino acid numbers 57-x to 57; and ending at any of amino acid numbers 58+((n−2)-x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA.sub.--1_P5 (SEQ ID NO:98) is encoded by the following transcript(s): Z21368_PEA.sub.--1_T9 (SEQ ID NO:61), for which the sequence(s) is/are given at the end of the application. The coding portion of transcript Z21368_PEA.sub.--1_T9 (SEQ ID NO:61) is shown in bold; this coding portion starts at position 556 and ends at position 2928.

Variant protein Z21368_PEA.sub.--1_P15 (SEQ ID NO:99) according to the present invention has an amino acid sequence as given at the end of the application; it is encoded by transcript(s) Z21368_PEA.sub.--1_T23 (SEQ ID NO:57). An alignment is given to the known protein (Extracellular sulfatase Sulf-1 precursor (SEQ ID NO:96)) at the end of the application. One or more alignments to one or more previously published protein sequences are given at the end of the application. A brief description of the relationship of the variant protein according to the present invention to each such aligned protein is as follows:

Comparison report between Z21368_PEA.sub.--1_P15 (SEQ ID NO:99) and SUL1_HUMAN (SEQ ID NO:96):

1. An isolated chimeric polypeptide encoding for Z21368_PEA.sub.--1_P15 (SEQ ID NO.99), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSVV QAM-HEPRTFAVYLNNTGYRTAFFGKYLNEY-NGSYIPPGWREWLGLIKNSRFYNYTVCR NGIKEKHGFDYAKDYFTDLITNESINY-FKMSKRMYPHRPVMMVISHMPHGPEDSAPQ FSKLYPNASQHITPSYNYAPNMDKHWIM-QYTGPMLPIHMEFTNILQRKRLQTLMSVDD SVER-LYNMLVETGELENTYIIYTADHGY-HIGQFGLVKGKSMPYDFDIRVPFFIRGPSVEP GSIVPQIVLNIDLAPTILDIAGLDTPPD-VDGKSVLKLLDPEKPGNRFRTNKKAKIWRDTFL VERG corresponding to amino acids 1-416 of SUL1_HUMAN (SEQ ID NO:96), which also corresponds to amino acids 1-416 of Z21368_PEA.sub.--1_P15 (SEQ ID NO:99).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA.sub.--1_P15 (SEQ ID NO:99) is encoded by the following transcript(s): Z21368_PEA.sub.--1_T23 (SEQ ID NO:57), for which the sequence(s) is/are given at the end of the application. The coding portion of transcript Z21368_PEA.sub.--1_T23 (SEQ ID NO:57) is shown in bold; this coding portion starts at position 691 and ends at position 1938.

Variant protein Z21368_PEA.sub.--1_P16 (SEQ ID NO:100) according to the present invention has an amino acid sequence as given at the end of the application; it is encoded by transcript(s) Z21368_PEA.sub.--1_T24 (SEQ ID NO:58). An alignment is given to the known protein (Extracellular sulfatase Sulf-1 precursor (SEQ ID NO:96)) at the end of the application. One or more alignments to one or more previously published protein sequences are given at the end of the application. A brief description of the relationship of the variant protein according to the present invention to each such aligned protein is as follows:

Comparison report between Z21368_PEA.sub.--1_P16 (SEQ ID NO:100) and SUL1_HUMAN (SEQ ID NO:96):

1. An isolated chimeric polypeptide encoding for Z21368_PEA.sub.--1_P16 (SEQ ID NO:100), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSVV QAM-HEPRTFAVYLNNTGYRTAFFGKYLNEY-NGSYIPPGWREWLGLIKNSRFYNYTVCR NGIKEKHGFDYAKDYFTDLITNESINY-FKMSKRMYPHRPVMMVISHMPHGPEDSAPQ FSKLYPNASQHITPSYNYAPNMDKHWIM-QYTGPMLPIHMEFTNILQRKRLQTLMSVDD SVER-LYNMLVETGELENTYIIYTADHGY-HIGQFGLVKGKSMPYDFDIRVPFFIRGPSVEP GSIVPQIVLNIDLAPTILDIAGLDTPPD-VDGKSVLKLLDPEKPGNR corresponding to amino acids 1-397 of SUL1_HUMAN (SEQ ID NO:96), which also corresponds to amino acids 1-397 of Z21368_PEA.sub.--1_P 16 (SEQ ID NO:100), and a second amino acid sequence being at least 70%, optionally at least 80%, preferably at least 85%, more preferably at least 90% and most preferably at least 95% homologous to a polypeptide having the sequence CVIVPPLSQPQIH (SEQ ID NO:1007) corresponding to amino acids 398-410 of Z21368_PEA.sub.--1_P16 (SEQ ID NO:100), wherein said first and second amino acid sequnes are contiguous and in a sequential order.

2. An isolated polypeptide encoding for a tail of Z21368_PEA.sub.--1_P 16 (SEQ ID NO:100), comprising a polypeptide being at least 70%, optionally at least about 80%, preferably at least about 85%, more preferably at least about 90% and most preferably at least about 95% homologous to the sequence CVIVPPLSQPQIH (SEQ ID NO:1007) in Z21368_PEA.sub.--1_P16 (SEQ ID NO:100).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA.sub.--1_P16 (SEQ ID NO:100) is encoded by the following transcript(s): Z21368_PEA.sub.--1_T24 (SEQ ID NO:58), for which the sequence(s) is/are given at the end of the application. The coding portion of transcript Z21368_PEA.sub.--1_T24 (SEQ ID NO:58) is shown in bold; this coding portion starts at position 691 and ends at position 1920.

Variant protein Z21368_PEA.sub.--1_P22 (SEQ ID NO:101) according to the present invention has an amino acid sequence as given at the end of the application; it is encoded by transcript(s) Z21368_PEA.sub.--1_T10 (SEQ ID NO:55) An alignment is given to the known protein (Extracellular sulfatase Sulf-1 precursor (SEQ ID NO:96) at the end of the application. One or more alignments to one or more previously published protein sequences are given at the end of the application. A brief description of the relationship of the variant protein according to the present invention to each such aligned protein is as follows:

Comparison report between Z21368_PEA.sub.--1_P22 (SEQ ID NO:101) and SUL1_HUMAN (SEQ ID NO:96):

1. An isolated chimeric polypeptide encoding for Z21368_PEA.sub.--1_P22 (SEQ ID NO:101), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSVV QAM-HEPRTFAVYLNNTGYRTAFFGKYLNEY-NGSYIPPGWREWLGLIKNSRFYNYTVCR NGIKEKHGFDYAK corresponding to amino acids 1-188 of SUL1_HUMAN (SEQ ID NO:96), which also corresponds to amino acids 1-188 of Z21368_PEA.sub.--1_P22 (SEQ ID NO:101), and a second amino acid sequence being at least 70%, optionally at least 80%, preferably at least 85%, more preferably at least 90% and most preferably at least 95% homologous to a polypeptide having the sequence ARYDGDQPRCAPRPRGLSPTVF (SEQ ID NO:1008) corresponding to amino acids 189-210 of Z21368_PEA.sub.--1_P22 (SEQ ID NO:101), wherein said first and second amino acid sequences are contiguous and in a sequential order.

2. An isolated polypeptide encoding for a tail of Z21368_PEA.sub.--1_P22 (SEQ ID NO:101), comprising a polypeptide being at least 70%, optionally at least about 80%, preferably at least about 85%, more preferably at least about 90% and most preferably at least about 95% homologous to the sequence ARYDGDQPRCAPRPRGLSPTVF (SEQ ID NO:1008) in Z21368_PEA.sub.--1_P22 (SEQ ID NO:101).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA.sub.--1_P22 (SEQ ID NO:101) is encoded by the following transcript(s):

Z21368_PEA.sub.--1_T10 (SEQ ID NO:55), for which the sequence(s) is/are given at the end of the application. The coding portion of transcript Z21368_PEA.sub.--1_T10 (SEQ ID NO:55) is shown in bold; this coding portion starts at position 691 and ends at position 1320.

Variant protein Z21368_PEA.sub.--1_P23 (SEQ ID NO:102) according to the present invention has an amino acid sequence as given at the end of the application; it is encoded by transcript(s) Z21368_PEA.sub.--1_T10 (SEQ ID NO:56). An alignment is given to the known protein (Extracellular sulfatase Sulf-1 precursor (SEQ ID NO:96)) at the end of the application. One or more alignments to one or more previously published protein sequences are given at the end of the application. A brief description of the relationship of the variant protein according to the present invention to each such aligned protein is as follows:

Comparison report between Z21368_PEA.sub.--1_P23 (SEQ ID NO:102) and Q7Z2W2 (SEQ ID NO:840):

1. An isolated chimeric polypeptide encoding for Z21368_PEA.sub.--1_P23 (SEQ ID NO:102), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSVV QAM-HEPRTFAVYLNNTGYRT corresponding to amino acids 1-137 of Q7Z2W2 (SEQ ID NO:840), which also corresponds to amino acids 1-137 of Z21368_PEA.sub.--1_P23 (SEQ ID NO:102), and a second amino acid sequence being at least 70%, optionally at least 80%, preferably at least 85%, more preferably at least 90% and most preferably at least 95% homologous to a polypeptide having the sequence GLL-HRLNH (SEQ ID NO:1009) corresponding to amino acids 138-145 of Z21368_PEA.sub.--1_P23 (SEQ ID NO:102), wherein said first and second amino acid sequences are contiguous and in a sequential order.

2. An isolated polypeptide encoding for a tail of Z21368_PEA.sub.--1_P23 (SEQ ID NO:102), comprising a polypeptide being at least 70%, optionally at least about 80%, preferably at least about 85%, more preferably at least about 90% and most preferably at least about 95% homologous to the sequence GLLHRLNH (SEQ ID NO:1009) in Z21368_PEA.sub.--1_P23 (SEQ ID NO:102).

Comparison report between Z21368_PEA.sub.--1_P23 (SEQ ID NO:102) and SUL1_HUMAN (SEQ ID NO:96):

1. An isolated chimeric polypeptide encoding for Z21368_PEA.sub.--1_P23 (SEQ ID NO:102), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSVV QAM-HEPRTFAVYLNNTGYRT corresponding to amino acids 1-137 of SUL1_HUMAN (SEQ ID NO:96), which also corresponds to amino acids 1-137 of Z21368_PEA.sub.--1_P23 (SEQ ID NO:102), and a second amino acid sequence being at least 70%, optionally at least 80%, preferably at least 85%, more preferably at least 90% and most preferably at least 95% homologous to a polypeptide having the sequence GLL-HRLNH (SEQ ID NO:1009) corresponding to amino acids 138-145 of Z21368_PEA.sub.--1_P23 (SEQ ID NO:102), wherein said first and second amino acid sequences are contiguous and in a sequential order.

2. An isolated polypeptide encoding for a tail of Z21368_PEA.sub.--1_P23 (SEQ ID NO:102), comprising a polypeptide being at least 70%, optionally at least about 80%, preferably at least about 85%, more preferably at least about 90% and most preferably at least about 95% homologous to the sequence GLLHRLNH (SEQ ID NO:1009) in Z21368_PEA.sub.--1_P23 (SEQ ID NO:102).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA.sub.--1_P23 (SEQ ID NO:102) is encoded by the following transcript(s): Z21368_PEA.sub.--1_T10 (SEQ ID NO:56), for which the sequence(s) is/are given at the end of the application. The coding portion of transcript Z21368_PEA.sub.--1_T11 (SEQ ID NO:56) is shown in bold; this coding portion starts at position 691 and ends at position 1125.

As noted above, cluster Z21368 features 34 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z21368_PEA.sub.--1_node.sub.--0 (SEQ ID NO:62) according to the present invention is supported by 8 libraries. The number of libraries was determined as previously described. This segment can be found in the following transcript(s): Z21368_PEA.sub.--1_T9 (SEQ ID NO:61). Table 7 below describes the starting and ending position of this segment on each transcript. TABLE-US-00195 TABLE 7 Segment location on transcripts Segment Segment ending Transcript name starting position position Z21368_PEA__1_T9 (SEQ ID 1 327 NO: 61)

Segment cluster Z21368_PEA.sub.--1_node.sub.--15 (SEQ ID NO:63) according to the present invention is supported by 26 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 8 below describes the starting and ending position of this segment on each transcript. TABLE-US-00196 TABLE 8 Segment location on transcripts Segment Segment ending Transcript name starting position position Z21368_PEA__1_T10 (SEQ 631 807 ID NO: 55) Z21368_PEA__1_T11 (SEQ 631 807 ID NO: 56) Z21368_PEA__1_T23 (SEQ 631 807 ID NO: 57) Z21368_PEA__1_T24 (SEQ 631 807 ID NO: 58) Z21368_PEA__1_T5 (SEQ ID 469 645 NO: 59) Z21368_PEA__1_T6 (SEQ ID 469 645 NO: 60) Z21368_PEA__1_T9 (SEQ ID 496 672 NO: 61)

Segment cluster Z21368_PEA.sub.--1_node.sub.--19 (SEQ ID NO:64) according to the present invention is supported by 24 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59) and Z21368_PEA.sub.--1_T6 (SEQ ID NO:60). Table 9 below describes the starting and ending position of this segment on each transcript. TABLE-US-00197 TABLE 9 Segment location on transcripts Segment Segment ending Transcript name starting position position Z21368_PEA__1_T10 (SEQ 863 1102 ID NO: 55) Z21368_PEA__1_T11 (SEQ 863 1102 ID NO: 56) Z21368_PEA__1_T23 (SEQ 863 1102 ID NO: 57) Z21368_PEA__1_T24 (SEQ 863 1102 ID NO: 58) Z21368_PEA__1_T5 (SEQ ID 701 940 NO: 59) Z21368_PEA__1_T6 (SEQ ID 701 940 NO: 60)

Segment cluster Z21368_PEA.sub.--1_node.sub.--2 (SEQ ID NO:65) according to the present invention is supported by 15 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59) and Z21368_PEA.sub.--1_T6 (SEQ ID NO:60). Table 10 below describes the starting and ending position of this segment on each transcript. TABLE-US-00198 TABLE 10 Segment location on transcripts Segment Segment ending Transcript name starting position position Z21368_PEA__1_T10 (SEQ 1 300 ID NO: 55) Z21368_PEA__1_T11 (SEQ 1 300 ID NO: 56) Z21368_PEA__1_T23 (SEQ 1 300 ID NO: 57) Z21368_PEA__1_T24 (SEQ 1 300 ID NO: 58) Z21368_PEA__1_T5 (SEQ ID 1 300 NO: 59) Z21368_PEA__1_T6 (SEQ ID 1 300 NO: 60)

Segment cluster Z21368_PEA.sub.--1_node.sub.--21 (SEQ ID NO:66) according to the present invention is supported by 37 libraries. The number of libraries was determined as previously described. This segment can be found in the following transcript(s): Z21368_PEA.sub.--1_T10 (SEQ ID NO:55), Z21368_PEA.sub.--1_T23 (SEQ ID NO:57), Z21368_PEA.sub.--1_T24 (SEQ ID NO:58), Z21368_PEA 1_T5 (SEQ ID NO:59), Z21368_PEA.sub.--1_T6 (SEQ ID NO:60) and Z21368_PEA.sub.--1_T9 (SEQ ID NO:61). Table 11 below describes the starting and ending position of this segment on each transcript. TABLE-US-00199 TABLE 11 Segment location on transcripts Segment Segment ending Transcript name starting position position Z21368_PEA__1_T10 (SEQ 1103 1254 ID NO: 55) Z21368_PEA__1_T23 (SEQ 1103 1254 ID NO: 57) Z21368_PEA__1_T24 (SEQ 1103 1254 ID NO: 58) Z21368_PEA__1_T5 (SEQ ID 941 1092 NO: 59) Z21368_PEA__1_T6 (SEQ ID 941 1092 NO: 60) Z21368_PEA__1_T9 (SEQ ID 728 879 NO: 61)

Segment cluster Z21368_PEA.sub.--1_node.sub.--33 (SEQ ID NO:67) according to the present invention is supported by 45 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 12 below describes the starting and ending position of this segment on each transcript. TABLE-US-00200 TABLE 12 Segment location on transcripts Segment Segment ending Transcript name starting position position Z21368_PEA__1_T10 (SEQ 1502 1677 ID NO: 55) Z21368_PEA__1_T11 (SEQ 1424 1599 ID NO: 56) Z21368_PEA__1_T23 (SEQ 1576 1751 ID NO: 57) Z21368_PEA__1_T24 (SEQ 1576 1751 ID NO: 58) Z21368_PEA__1_T5 (SEQ ID 1414 1589 NO: 59) Z21368_PEA__1_T6 (SEQ ID 1414 1589 NO: 60) Z21368_PEA__1_T9 (SEQ ID 1201 1376 NO: 61)

Segment cluster Z21368_PEA.sub.--1_node.sub.--36 (SEQ ID NO:68) according to the present invention is supported by 44 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 13 below describes the starting and ending position of this segment on each transcript. TABLE-US-00201 TABLE 13 Segment location on transcripts Segment Segment ending Transcript name starting position position Z21368_PEA__1_T10 (SEQ 1678 1806 ID NO: 55) Z21368_PEA__1_T11 (SEQ 1600 1728 ID NO: 56) Z21368_PEA__1_T23 (SEQ 1752 1880 ID NO: 57) Z21368_PEA__1_T24 (SEQ 1752 1880 ID NO: 58) Z21368_PEA__1_T5 (SEQ ID 1590 1718 NO: 59) Z21368_PEA__1_T6 (SEQ ID 1590 1718 NO: 60) Z21368_PEA__1_T9 (SEQ ID 1377 1505 NO: 61)

Segment cluster Z21368_PEA.sub.--1_node.sub.--37 (SEQ ID NO:69) according to the present invention is supported by 3 libraries. The number of libraries was determined as previously described. This segment can be found in the following transcript(s): Z21368_PEA.sub.--1_T24 (SEQ ID NO:58). Table 14 below describes the starting and ending position of this segment on each transcript. TABLE-US-00202 TABLE 14 Segment location on transcripts Segment Transcript name starting position Segment ending position Z21368_PEA__1_T24 1881 2159 (SEQ ID NO: 58)

Segment cluster Z21368_PEA.sub.--1_node.sub.--39 (SEQ ID NO:70) according to the present invention is supported by 5 libraries. The number of libraries was determined as previously described. This segment can be found in the following transcript(s): Z21368_PEA.sub.--1_T23 (SEQ ID NO:57) and Z21368_PEA.sub.--1_T24 (SEQ ID NO:58). Table 15 below describes the starting and ending position of this segment on each transcript. TABLE-US-00203 TABLE 15 Segment location on transcripts Segment Transcript name Segment starting position ending position Z21368_PEA__1_T23 (SEQ 1938 2790 ID NO: 57) Z21368_PEA__1_T24 (SEQ 2217 3069 ID NO: 58)

Segment cluster Z21368_PEA.sub.--1_node.sub.--4 (SEQ ID NO:71) according to the present invention is supported by 13 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57) and Z21368_PEA.sub.--1_T24 (SEQ ID NO:58). Table 16 below describes the starting and ending position of this segment on each transcript. TABLE-US-00204 TABLE 16 Segment location on transcripts Segment Transcript name Segment starting position ending position Z21368_PEA__1_T10 (SEQ 301 462 ID NO: 55) Z21368_PEA__1_T11 (SEQ 301 462 ID NO: 56) Z21368_PEA__1_T23 (SEQ 301 462 ID NO: 57) Z21368_PEA__1_T24 (SEQ 301 462 ID NO: 58)

Segment cluster Z21368_PEA.sub.--1_node.sub.--41 (SEQ ID NO:72) according to the present invention is supported by 49 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 17 below describes the starting and ending position of this segment on each transcript. TABLE-US-00205 TABLE 17 Segment location on transcripts Segment Segment Transcript name starting position ending position Z21368_PEA__1_T10 (SEQ 1864 1993 ID NO: 55) Z21368_PEA__1_T11 (SEQ 1786 1915 ID NO: 56) Z21368_PEA__1_T5 (SEQ ID 1776 1905 NO: 59) Z21368_PEA__1_T6 (SEQ ID 1776 1905 NO: 60) Z21368_PEA__1_T9 (SEQ ID 1563 1692 NO: 61)

Segment cluster Z21368_PEA.sub.--1_node.sub.--43 (SEQ ID NO:73) according to the present invention is supported by 52 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 18 below describes the starting and ending position of this segment on each transcript. TABLE-US-00206 TABLE 18 Segment location on transcripts Segment Segment Transcript name starting position ending position Z21368_PEA__1_T10 (SEQ 1994 2210 ID NO: 55) Z21368_PEA__1_T11 (SEQ 1916 2132 ID NO: 56) Z21368_PEA__1_T5 (SEQ ID 1906 2122 NO: 59) Z21368_PEA__1_T6 (SEQ ID 1906 2122 NO: 60) Z21368_PEA__1_T9 (SEQ ID 1693 1909 NO: 61)

Segment cluster Z21368_PEA.sub.--1_node.sub.--45 (SEQ ID NO:74) according to the present invention is supported by 64 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 19 below describes the starting and ending position of this segment on each transcript. TABLE-US-00207 TABLE 19 Segment location on transcripts Segment Segment Transcript name starting position ending position Z21368_PEA__1_T10 (SEQ 2211 2466 ID NO: 55) Z21368_PEA__1_T11 (SEQ 2133 2388 ID NO: 56) Z21368_PEA__1_T5 (SEQ ID 2123 2378 NO: 59) Z21368_PEA__1_T6 (SEQ ID 2123 2378 NO: 60) Z21368_PEA__1_T9 (SEQ ID 1910 2165 NO: 61)

Segment cluster Z21368_PEA.sub.--1_node.sub.--53 (SEQ ID NO:75) according to the present invention is supported by 60 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 20 below describes the starting and ending position of this segment on each transcript. TABLE-US-00208 TABLE 20 Segment location on transcripts Segment Segment Transcript name starting position ending position Z21368_PEA__1_T10 (SEQ 2725 2900 ID NO: 55) Z21368_PEA__1_T11 (SEQ 2647 2822 ID NO: 56) Z21368_PEA__1_T5 (SEQ ID 2637 2812 NO: 59) Z21368_PEA__1_T6 (SEQ ID 2637 2812 NO: 60) Z21368_PEA__1_T9 (SEQ ID 2424 2599 NO: 61)

Segment cluster Z21368_PEA.sub.--1_node.sub.--56 (SEQ ID NO:76) according to the present invention is supported by 50 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56) and Z21368_PEA.sub.--1_T9 (SEQ ID NO:61). Table 21 below describes the starting and ending position of this segment on each transcript. TABLE-US-00209 TABLE 21 Segment location on transcripts Segment Segment Transcript name starting position ending position Z21368_PEA__1_T10 (SEQ 2901 3043 ID NO: 55) Z21368_PEA__1_T11 (SEQ 2823 2965 ID NO: 56) Z21368_PEA__1_T9 (SEQ 2600 2742 ID NO: 61)

Segment cluster Z21368_PEA.sub.--1_node.sub.--58 (SEQ ID NO:77) according to the present invention is supported by 71 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 22 below describes the starting and ending position of this segment on each transcript. TABLE-US-00210 TABLE 22 Segment location on transcripts Segment Segment Transcript name starting position ending position Z21368_PEA__1_T10 (SEQ 3044 3167 ID NO: 55) Z21368_PEA__1_T11 (SEQ 2966 3089 ID NO: 56) Z21368_PEA__1_T5 (SEQ ID 2813 2936 NO: 59) Z21368_PEA__1_T6 (SEQ ID 2813 2936 NO: 60) Z21368_PEA__1_T9 (SEQ ID 2743 2866 NO: 61)

Segment cluster Z21368_PEA.sub.--1_node.sub.--66 (SEQ ID NO:78) according to the present invention is supported by 142 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56, Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 23 below describes the starting and ending position of this segment on each transcript. TABLE-US-00211 TABLE 23 Segment location on transcripts Segment Segment Transcript name starting position ending position Z21368_PEA__1_T10 (SEQ 3202 3789 ID NO: 55) Z21368_PEA__1_T11 (SEQ 3124 3711 ID NO: 56) Z21368_PEA__1_T5 (SEQ ID 2971 3558 NO: 59) Z21368_PEA__1_T6 (SEQ ID 2971 3558 NO: 60) Z21368_PEA__1_T9 (SEQ ID 2901 3488 NO: 61)

Segment cluster Z21368_PEA.sub.--1_node.sub.--67 (SEQ ID NO:79) according to the present invention is supported by 181 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 24 below describes the starting and ending position of this segment on each transcript. TABLE-US-00212 TABLE 24 Segment location on transcripts Segment Segment Transcript name starting position ending position Z21368_PEA__1_T10 (SEQ 3790 4374 ID NO: 55) Z21368_PEA__1_T11 (SEQ 3712 4296 ID NO: 56) Z21368_PEA__1_T5 (SEQ ID 3559 4143 NO: 59) Z21368_PEA__1_T6 (SEQ ID 3559 4143 NO: 60) Z21368_PEA__1_T9 (SEQ ID 3489 4073 NO: 61)

Segment cluster Z21368_PEA.sub.--1_node.sub.--69 (SEQ ID NO:80) according to the present invention is supported by 150 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 25 below describes the starting and ending position of this segment on each transcript. TABLE-US-00213 TABLE 25 Segment location on transcripts Segment Segment Transcript name starting position ending position Z21368_PEA_1_T10 (SEQ 4428 4755 ID NO: 55) Z21368_PEA_1_T11 (SEQ 4350 4677 ID NO: 56) Z21368_PEA_1_T5 (SEQ ID 4197 5384 NO: 59) Z21368_PEA_1_T6 (SEQ ID 4197 4524 NO: 60) Z21368_PEA_1_T9 (SEQ ID 4127 4454 NO: 61)

According to an optional embodiment of the present invention, short segments related to the above cluster are also provided. These segments are up to about 120 bp in length, and so are included in a separate description.

Segment cluster Z21368_PEA.sub.--1_node.sub.--11 (SEQ ID NO:81) according to the present invention is supported by 26 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 26 below describes the starting and ending position of this segment on each transcript. TABLE-US-00214 TABLE 26 Segment location on transcripts Segment Segment Transcript name starting position ending position Z21368_PEA_1_T10 (SEQ 558 602 ID NO: 55) Z21368_PEA_1_T11 (SEQ 558 602 ID NO: 56) Z21368_PEA_1_T23 (SEQ 558 602 ID NO: 57) Z21368_PEA_1_T24 (SEQ 558 602 ID NO: 58) Z21368_PEA_1_T5 (SEQ ID 396 440 NO: 59) Z21368_PEA_1_T6 (SEQ ID 396 440 NO: 60) Z21368_PEA_1_T9 (SEQ ID 423 467 NO: 61)

Segment cluster Z21368_PEA.sub.--1_node.sub.--12 (SEQ ID NO:82) according to the present invention is supported by 23 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 27 below describes the starting and ending position of this segment on each transcript. TABLE-US-00215 TABLE 27 Segment location on transcripts Segment Segment Transcript name starting position ending position Z21368_PEA_1_T10 (SEQ 603 630 ID NO: 55) Z21368_PEA_1_T11 (SEQ 603 630 ID NO: 56) Z21368_PEA_1_T23 (SEQ 603 630 ID NO: 57) Z21368_PEA_1_T24 (SEQ 603 630 ID NO: 58) Z21368_PEA_1_T5 (SEQ ID 441 468 NO: 59) Z21368_PEA_1_T6 (SEQ ID 441 468 NO: 60) Z21368_PEA_1_T9 (SEQ ID 468 495 NO: 61)

Segment cluster Z21368_PEA.sub.--1_node.sub.--16 (SEQ ID NO:83) according to the present invention can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 28 below describes the starting and ending position of this segment on each transcript. TABLE-US-00216 TABLE 28 Segment location on transcripts Segment Segment Transcript name starting position ending position Z21368_PEA_1_T10 (SEQ 808 822 ID NO: 55) Z21368_PEA_1_T11 (SEQ 808 822 ID NO: 56) Z21368_PEA_1_T23 (SEQ 808 822 ID NO: 57) Z21368_PEA_1_T24 (SEQ 808 822 ID NO: 58) Z21368_PEA_1_T5 (SEQ ID 646 660 NO: 59) Z21368_PEA_1_T6 (SEQ ID 646 660 NO: 60) Z21368_PEA_1_T9 (SEQ ID 673 687 NO: 61)

Segment cluster Z21368_PEA.sub.--1_node.sub.--17 (SEQ ID NO:84) according to the present invention is supported by 19 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 29 below describes the starting and ending position of this segment on each transcript. TABLE-US-00217 TABLE 29 Segment location on transcripts Segment Segment Transcript name starting position ending position Z21368_PEA_1_T10 (SEQ 823 862 ID NO: 55) Z21368_PEA_1_T11 (SEQ 823 862 ID NO: 56) Z21368_PEA_1_T23 (SEQ 823 862 ID NO: 57) Z21368_PEA_1_T24 (SEQ 823 862 ID NO: 58) Z21368_PEA_1_T5 (SEQ ID 661 700 NO: 59) Z21368_PEA_1_T6 (SEQ ID 661 700 NO: 60) Z21368_PEA_1_T9 (SEQ ID 688 727 NO: 61)

Segment cluster Z21368_PEA.sub.--1_node.sub.--23 (SEQ ID NO:85) according to the present invention is supported by 36 libraries. The number of libraries was determined as previously described. This segment can be found in the following transcript(s): Z21368_PEA.sub.--1_T11 (SEQ ID NO:56), Z21368_PEA.sub.--1_T23 (SEQ ID NO:57) Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 30 below describes the starting and ending position of this segment on each transcript. TABLE-US-00218 TABLE 30 Segment location on transcripts Segment Segment Transcript name starting position ending position Z21368_PEA_1_T11 (SEQ 1103 1176 ID NO: 56) Z21368_PEA_1_T23 (SEQ 1255 1328 ID NO: 57) Z21368_PEA_1_T24 (SEQ 1255 1328 ID NO: 58) Z21368_PEA_1_T5 (SEQ ID 1093 1166 NO: 59) Z21368_PEA_1_T6 (SEQ ID 1093 1166 NO: 60) Z21368_PEA_1_T9 (SEQ ID 880 953 NO: 61)

Segment cluster Z21368_PEA.sub.--1_node.sub.--24 (SEQ ID NO:86) according to the present invention is supported by 36 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 31 below describes the starting and ending position of this segment on each transcript. TABLE-US-00219 TABLE 31 Segment location on transcripts Segment Segment Transcript name starting position ending position Z21368_PEA_1_T10 (SEQ 1255 1350 ID NO: 55) Z21368_PEA_1_T11 (SEQ 1177 1272 ID NO: 56) Z21368_PEA_1_T23 (SEQ 1329 1424 ID NO: 57) Z21368_PEA_1_T24 (SEQ 1329 1424 ID NO: 58) Z21368_PEA_1_T5 (SEQ ID 1167 1262 NO: 59) Z21368_PEA_1_T6 (SEQ ID 1167 1262 NO: 60) Z21368_PEA_1_T9 (SEQ ID 954 1049 NO: 61)

Segment cluster Z21368_PEA.sub.--1_node.sub.--30 (SEQ ID NO:87) according to the present invention is supported by 39 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 32 below describes the starting and ending position of this segment on each transcript. TABLE-US-00220 TABLE 32 Segment location on transcripts Segment Segment Transcript name starting position ending position Z21368_PEA__1_T10 (SEQ 1351 1409 ID NO: 55) Z21368_PEA__1_T11 (SEQ 1273 1331 ID NO: 56) Z21368_PEA__1_T23 (SEQ 1425 1483 ID NO: 57) Z21368_PEA__1_T24 (SEQ 1425 1483 ID NO: 58) Z21368_PEA__1_T5 (SEQ ID 1263 1321 NO: 59) Z21368_PEA__1_T6 (SEQ ID 1263 1321 NO: 60) Z21368_PEA__1_T9 (SEQ ID 1050 1108 NO: 61)

Segment cluster Z21368_PEA.sub.--1_node.sub.--31 (SEQ ID NO:88) according to the present invention is supported by 40 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 33 below describes the starting and ending position of this segment on each transcript. TABLE-US-00221 TABLE 33 Segment location on transcripts Segment Segment Transcript name starting position ending position Z21368_PEA__1_T10 (SEQ 1410 1501 ID NO: 55) Z21368_PEA__1_T11 (SEQ 1332 1423 ID NO: 56) Z21368_PEA__1_T23 (SEQ 1484 1575 ID NO: 57) Z21368_PEA__1_T24 (SEQ 1484 1575 ID NO: 58) Z21368_PEA__1_T5 (SEQ ID 1322 1413 NO: 59) Z21368_PEA__1_T6 (SEQ ID 1322 1413 NO: 60) Z21368_PEA__1_T9 (SEQ ID 1109 1200 NO: 61)

Segment cluster Z21368_PEA.sub.--1_node.sub.--38 (SEQ ID NO:89) according to the present invention is supported by 45 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 34 below describes the starting and ending position of this segment on each transcript. TABLE-US-00222 TABLE 34 Segment location on transcripts Segment Segment Transcript name starting position ending position Z21368_PEA__1_T10 (SEQ 1807 1863 ID NO: 55) Z21368_PEA__1_T11 (SEQ 1729 1785 ID NO: 56) Z21368_PEA__1_T23 (SEQ 1881 1937 ID NO: 57) Z21368_PEA__1_T24 (SEQ 2160 2216 ID NO: 58) Z21368_PEA__1_T5 (SEQ ID 1719 1775 NO: 59) Z21368_PEA__1_T6 (SEQ ID 1719 1775 NO: 60) Z21368_PEA__1_T9 (SEQ ID 1506 1562 NO: 61)

Segment cluster Z21368_PEA.sub.--1_node.sub.--47 (SEQ ID NO:90) according to the present invention is supported by 61 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 35 below describes the starting and ending position of this segment on each transcript. TABLE-US-00223 TABLE 35 Segment location on transcripts Segment Segment Transcript name starting position ending position Z21368_PEA__1_T10 (SEQ 2467 2563 ID NO: 55) Z21368_PEA__1_T11 (SEQ 2389 2485 ID NO: 56) Z21368_PEA__1_T5 (SEQ ID 2379 2475 NO: 59) Z21368_PEA__1_T6 (SEQ ID 2379 2475 NO: 60) Z21368_PEA__1_T9 (SEQ ID 2166 2262 NO: 61)

Segment cluster Z21368_PEA.sub.--1_node.sub.--49 (SEQ ID NO 91) according to the present invention is supported by 57 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 36 below describes the starting and ending position of this segment on each transcript. TABLE-US-00224 TABLE 36 Segment location on transcripts Segment Segment Transcript name starting position ending position Z21368_PEA__1_T10 (SEQ 2564 2658 ID NO: 55) Z21368_PEA__1_T11 (SEQ 2486 2580 ID NO: 56) Z21368_PEA__1_T5 (SEQ ID 2476 2570 NO: 59) Z21368_PEA__1_T6 (SEQ ID 2476 2570 NO: 60) Z21368_PEA__1_T9 (SEQ ID 2263 2357 NO: 61)

Segment cluster Z21368_PEA.sub.--1_node.sub.--51 (SEQ ID NO:92) according to the present invention is supported by 46 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 37 below describes the starting and ending position of this segment on each transcript. TABLE-US-00225 TABLE 37 Segment location on transcripts Segment Segment Transcript name starting position ending position Z21368_PEA__1_T10 (SEQ 2659 2724 ID NO: 55) Z21368_PEA__1_T11 (SEQ 2581 2646 ID NO: 56) Z21368_PEA__1_T5 (SEQ ID 2571 2636 NO: 59) Z21368_PEA__1_T6 (SEQ ID 2571 2636 NO: 60) Z21368_PEA__1_T9 (SEQ ID 2358 2423 NO: 61)

Segment cluster Z21368_PEA.sub.--1_node.sub.--61 (SEQ ID NO:93) according to the present invention is supported by 61 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 38 below describes the starting and ending position of this segment on each transcript. TABLE-US-00226 TABLE 38 Segment location on transcripts Segment Segment Transcript name starting position ending position Z21368_PEA__1_T10 (SEQ 3168 3201 ID NO: 55) Z21368_PEA__1_T11 (SEQ 3090 3123 ID NO: 56) Z21368_PEA__1_T5 (SEQ ID 2937 2970 NO: 59) Z21368_PEA__1_T6 (SEQ ID 2937 2970 NO: 60) Z21368_PEA__1_T9 (SEQ ID 2867 2900 NO: 61)

Segment cluster Z21368_PEA.sub.--1_node.sub.--68 (SEQ ID NO 94) according to the present invention is supported by 87 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 39 below describes the starting and ending position of this segment on each transcript. TABLE-US-00227 TABLE 39 Segment location on transcripts Segment Segment Transcript name starting position ending position Z21368_PEA__1_T10 (SEQ 4375 4427 ID NO: 55) Z21368_PEA__1_T11 (SEQ 4297 4349 ID NO: 56) Z21368_PEA__1_T5 (SEQ ID 4144 4196 NO: 59) Z21368_PEA__1_T6 (SEQ ID 4144 4196 NO: 60) Z21368_PEA__1_T9 (SEQ ID 4074 4126 NO: 61)

Segment cluster Z21368_PEA.sub.--1_node.sub.--7 (SEQ ID NO:95) according to the present invention is supported by 29 libraries. The number of libraries was determined as previously described. This segment can be found in the following transcript(s): Z21368_PEA.sub.--1_T10 (SEQ ID NO:55), Z21368_PEA.sub.--1_T11 (SEQ ID NO:56), Z21368_PEA.sub.--1_T23 (SEQ ID NO:57), Z21368_PEA.sub.--1_T24 (SEQ ID NO:58), Z21368_PEA.sub.--1_T5 (SEQ ID NO:59), Z21368_PEA.sub.--1_T6 (SEQ ID NO:60) and Z21368_PEA.sub.--1_T9 (SEQ ID NO:61). Table 40 below describes the starting and ending position of this segment on each transcript. TABLE-US-00228 TABLE 40 Segment location on transcripts Segment Segment Transcript name starting position ending position Z21368_PEA__1_T10 (SEQ 463 557 ID NO: 55) Z21368_PEA__1_T11 (SEQ 463 557 ID NO: 56) Z21368_PEA__1_T23 (SEQ 463 557 ID NO: 57) Z21368_PEA__1_T24 (SEQ 463 557 ID NO: 58) Z21368_PEA__1_T5 (SEQ ID 301 395 NO: 59) Z21368_PEA__1_T6 (SEQ ID 301 395 NO: 60) Z21368_PEA__1_T9 (SEQ ID 328 422 NO: 61)

Overexpression of at least a portion of this cluster was determined according to oligonucleotides and one or more chips. The results were as follows: Oligonucleotide Z21368.sub.--0.sub.--0.sub.--61857 was on the TAA chip and was found to be overexpressed in breast cancer.

Variant protein alignment to the previously known protein:

Sequence name: /tmp/5ER3vIMKE2/9L0Y7IDITQ: SUL1_HUMAN (SEQ ID NO:96)

Sequence documentation:

Alignment of: Z21368_PEA.sub.--1_P2 (SEQ ID NO:97).times.SUL1_HUMAN (SEQ ID NO:96).

Alignment segment 1/1: TABLE-US-00229 Quality: 7664.00 Score: 0 Matching length: 761 Total length: 761 Matching Percent 100.00 Matching Percent Identity: 100.00 Similarity: Total Percent Similarity: 100.00 Total Percent Identity: 100.00 Gaps: 0

```
Alignment: TABLE-US-00230 . . . 1
MKYSCCALVLAVLGTELLGSLCSTVRSPRFRGRIQQERKNIRPNIILVLT  50
|||||||||||||||||||||||||||||||||||||||||||||||||  1
MKYSCCALVLAVLGTELLGSLCSTVRSPRFRGRIQQERKNIRPNIILVLT  50 . . . 51

DDQDVELGSLQVMNKTRKIMEHGGATFINAFVTTPMCCPSRSSMLTGKYV  100
|||||||||||||||||||||||||||||||||||||||||||||||||  51
DDQDVELGSLQVMNKTRKIMEHGGATFINAFVTTPMCCPSRSSMLTGKYV  100 . . . 101

HNHNVYTNNENCSSPSWQAMHEPRTFAVYLNNTGYRTAFFGKYLNEYNGS  150
|||||||||||||||||||||||||||||||||||||||||||||||||  101
HNHNVYTNNENCSSPSWQAMHEPRTFAVYLNNTGYRTAFFGKYLNEYNGS  150 . . . 151

YIPPGWREWLGLIKNSRFYNYTVCRNGIKEKHGFDYAKDYFTDLITNESI  200
|||||||||||||||||||||||||||||||||||||||||||||||||  151
YIPPGWREWLGLIKNSRFYNYTVCRNGIKEKHGFDYAKDYFTDLITNESI  200 . . . 201

NYFKMSKRMYPHRPVMMVISHAAPHGPEDSAPQFSKLYPNASQHITPSYN  250
|||||||||||||||||||||||||||||||||||||||||||||||||  201
NYFKMSKRMYPHRPVMMVISHAAPHGPEDSAPQFSKLYPNASQHITPSYN  250 . . . 251

YAPNMDKHWIMQYTGPMLPIHMEFTNILQRKRLQTLMSVDDSVERLYNML  300
|||||||||||||||||||||||||||||||||||||||||||||||||  251
YAPNMDKHWIMQYTGPMLPIHMEFTNILQRKRLQTLMSVDDSVERLYNML  300 . . . 301

VETGELENTYIIYTADHGYHIGQFGLVKGKSMPYDFDIRVPFFIRGPSVE  350
|||||||||||||||||||||||||||||||||||||||||||||||||  301
VETGELENTYIIYTADHGYHIGQFGLVKGKSMPYDFDIRVPFFIRGPSVE  350 . . . 351

PGSIVPQIVLNIDLAPTILDIAGLDTPPDVDGKSVLKLLDPEKPGNRFRT  400
|||||||||||||||||||||||||||||||||||||||||||||||||  351
PGSIVPQIVLNIDLAPTILDIAGLDTPPDVDGKSVLKLLDPEKPGNRFRT  400 . . . 401

NKKAKIWRDTFLVERGKFLRKKEESSKNIQQSNHLPKYERVKELCQQARY  450
|||||||||||||||||||||||||||||||||||||||||||||||||  401
NKKAKIWRDTFLVERGKFLRKKEESSKNIQQSNHLPKYERVKELCQQARY  450 . . . 451

QTACEQPGQKWQCIEDTSGKLRIHKCKGPSDLLTVRQSTRNLYARGFHDK  500
|||||||||||||||||||||||||||||||||||||||||||||||||  451
QTACEQPGQKWQCIEDTSGKLRIHKCKGPSDLLTVRQSTRNLYARGFHDK  500 . . . 501

DKECSCRESGYRASRSQRKSQRQFLRNQGTPKYKPRFVHTRQTRSLSVEF  550
|||||||||||||||||||||||||||||||||||||||||||||||||  501
DKECSCRESGYRASRSQRKSQRQFLRNQGTPKYKPRFVHTRQTRSLSVEF  550 . . . 551

EGEIYDINLEEEELQVLQPRNIAKRHDEGHKGPRDLQASSGGNRGRMLA  600
```

```
                                                    551
EGEIYDINLEEEEELQVLQPRNIAKRHDEGHKGPRDLQASSGGNRGRMLA  600 . . . 601

DSSNAVGPPTTVRVTHKCFILPNDSIHCERELYQSARAWKDHKAYIDKEI  650
                                                    601
DSSNAVGPPTTVRVTHKCFILPNDSIHCERELYQSARAWKDHKAYIDKEI  650 . . . 651

EALQDKIKNLREVRGHLKRRKPEECSCSKQSYYNKEKGVKKQEKLKSHLH  700
                                                    651
EALQDKIKNLREVRGHLKRRKPEECSCSKQSYYNKEKGVKKQEKLKSHLH  700 . . . 701

PFKEAAQEVDSKLQLFKENNRRRKKERKEKRRQRKGEECSLPGLTCFTHD  750
                                                    701
PFKEAAQEVDSKLQLFKENNRRRKKERKEKRRQRKGEECSLPGLTCFTHD  750 . . . 751

NNHWQTAPFWN                                         761
                                                    751
NNHWQTAPFWN                                         761
```

Sequence name: /tmp/tt3yfXIUKV/YxSTFWr66h: Q7Z2W2 (SEQ ID NO:840)

Sequence documentation:

Alignment of: Z21368_PEA.sub.--1_P5 (SEQ ID NO:98).times.Q7Z2W2 (SEQ ID NO:840).

Alignment segment 1/1: TABLE-US-00231 Quality: 7869.00 Score: 0 Matching length: 791 Total length: 871 Matching Percent 99.87 Matching Percent Identity: 99.87 Similarity: Total Percent Similarity: 90.70 Total Percent Identity: 90.70 Gaps: 1

```
Alignment: TABLE-US-00232 . . . 1
MKYSCCALVLAVLGTELLGSLCSTVRSPRFRGRIQQERKNIRPNIILVLT  50
                                                    1
MKYSCCALVLAVLGTELLGSLCSTVRSPRFRGRIQQERKNIRPNIILVLT  50 . . . 51

DDQDVELA.........................................  58
                                                    51
DDQDVELGSLQVMNKTRKIMEHGGATFTNAFVTTPMCCPSRSSMLTGKYV  100 . . . 59

..................................FFGKYLNEYNGS     70
                                                    101
HNHNVYTNNENCSSPSWQAMHEPRTFAVYLNNTGYRTVFFGKYLNEYNGS  150 . . . 71

YIPPGWREWLGLIKNSRFYNYTVCRNGIKEKHGFDYAKDYFTDLITNESI  120
                                                    151
YIPPGWREWLGLIKNSRFYNYTVCRNGIKEKHGFDYAKDYFTDLITNESI  200 . . . 121

NYFKMSKRMYPHRPVMMVISHAAPHGPEDSAPQFSKLYPNASQHITPSYN  170
                                                    201
NYFKMSKRMYPHRPVMMVISHAAPRGPEDSAPQFSKLYPNASQHITPSYN  250 . . . 171

YAPNMDKHWIMQYTGPMLPIHMEFTNILQRKRLQTLMSVDDSVERLYNML  220
                                                    251
YAPNMDKHWIMQYTGPMLPIHMEFTNILQRKRLQTLMSVDDSVERLYNML  300 . . . 221

VETGELENTYIIYTADHGYHIGQFGLVKGKSMPYDFDIRVPFFIRGPSVE  270
                                                    301
VETGELENTYIIYTADHGYHIGQFGLVKGKSMPYDFDIRVPFFIRGPSVE  350 . . . 271

PGSIVPQIVLNIDLAPTILDTAGLDTPPDVDGKSVLKLLDPEKPGNRFRT  320
                                                    351
PGSIVPQIVLNIDLAPTILDIAGLDTPPDVDGKSVLKLLDPEKPGNRFRT  400 . . . 321

NKKAKIWRDTFLVERGKFLRKKEESSKNIQQSNHLPKYERVKELCQQARY  370
                                                    401
NKKAKIWRDTFLVERGKFLRKKEESSKNIQQSNHLPKYERVKELCQQARY  450 . . . 371

QTACEQPGQKWQCIEDTSGKLRIHKCKGPSDLLTVRQSTRNLYARGFHDK  420
                                                    451
QTACEQPGQKWQCIEDTSGKLRIHKCKGPSDLLTVRQSTRNLYARGFHDK  500 . . . 421

DKECSCRESGYRASRSQRKSQRQFLRNQGTPKYKPRFVHTRQTRSLSVEF  470
                                                    501
DKECSCRESGYRASRSQRKSQRQFLRNQGTPKYKPRFVHTRQRRSLSVEF  550 . . . 471

EGEIYDINLEEEEELQVLQPRNIAKRHDEGHKGPRDLQASSGGNRGRMLA  520
                                                    551
EGEIYDINLEEEEELQVLQPRNIAKRHDEGHKGPRDLQASSGGNRGRMLA  600 . . . 521

DSSNAVGPPTTVRVTHKCFILPNDSIHCERELYQSARAWKDHKAYIDKEI  570
```

```
                                                 601
DSSNAVGPPTTVRVTHKCFILPNDSIHCERELYQSARAWKDHKAYIDKEI  650  ...  571

EALQDKIKNLREVRGHLKRRKPEECSCSKQSYYNKEKGVKKQEKLKSHLH  620
                                                 651
EALQDKIKNLREVRGHLKRRKPEECSCSKQSYYNKEKGVKKQEKLKSHLH  700  ...  621

PFKEAAQEVDSKLQLFKENNRRRKKERKEKRRQRKGEECSLPGLTCFTHD  670
                                                 701
PFKEAAQEVDSKLQLFKENNRRRKKERKEKRRQRKGEECSLPGLTCFTHD  750  ...  671

NNHWQTAPFWNLGSFCACTSSNNNTYWCLRTVNETHNFLFCEFATGFLEY  720
                                                 751
NNHWQTAPFWNLGSFCACTSSNNNTYWCLRTVNETHNFLFCEFATGFLEY  800  ...  721

FDMNTDPYQLTNTVHTVERGILNQLHVQLMELRSCQGYKQCNPRPKNLDV  770
                                                 801
FDMNTDPYQLTNTVHTVERGILNQLHVQLMELRSCQGYKQCNPRPKNLDV  850  ...  771

GNKDGGSYDLHRGQLWDGWEG                             791
                                                 851
GNKDGGSYDLHRGQLWDGWEG                             871
```

Sequence name: /tmp/tt3yfXIUKV/YxSTFWr66h:AAH12997 (SEQ ID NO:841)

Sequence documentation:

Alignment of: Z21368_PEA.sub.--1_P5 (SEQ ID NO:98).times.MH12997 (SEQ ID NO:841).

Alignment segment 1/1: TABLE-US-00233 Quality: 420.00 Score: 0 Matching length: 40 Total length: 40 Matching Percent 100.00 Matching Percent Identity: 100.00 Similarity: Total Percent Similarity: 100.00 Total Percent Identity: 100.00 Gaps: 0

```
Alignment: TABLE-US-00234 ... 752
LRSCQGYKQCNPRPKNLDVGNKDGGSYDLHRGQLWDGWEG          791
```

```
                                                  1
LRSCQGYKQCNPRPKNLDVGNKDGGSYDLHRGQLWDGWEG          40
```

Sequence name: /tmp/tt3yfXIUKV/YxSTFWr66h:SUL1_HUMAN (SEQ ID NO:96)

Sequence documentation:

Alignment of: Z21368_PEA.sub.--1_P5 (SEQ ID NO:98).times.SUL1_HUMAN (SEQ ID NO:96).

Alignment segment 1/1: TABLE-US-00235 Quality: 7878.00 Score: 0 Matching length: 791 Total length: 871 Matching Percent 100.00 Matching Percent Identity: 100.00 Similarity: Total Percent Similarity: 90.82 Total Percent Identity: 90.82 Gaps: 1

```
Alignment: TABLE-US-00236 ... 1
MKYSCCALVLAVLGTELLGSLCSTVRSPRFRGRIQQERKNIRPNIILVLT  50
                                                  1
MKYSCCALVLAVLGTELLGSLCSTVRSPRFRGRIQQERKNIRPNIILVLT  50  ...  51

DDQDVEL............................................  57
                                                  51
DDQDVELGSLQVMNKTRKIMEHGGATFINAFVTTPMCCPSRSSMLTGKYV  100  ...  58

...............................AFFGKYLNEYNGS       70
                                                  101
HNHNVYTNNENCSSPSWQAMHEPRTFAVYLNNTGYRTAFFGKYLNEYNGS  150  ...  71

YIPPGWREWLGLIKNSRFYNYTVCRNGIKEKHGFDYAKDYFTDLITNESI  120
                                                  151
YIPPGWREWLGLIKNSRFYNYTVCRNGIKEKHGFDYAKDYFTDLITNESI  200  ...  121

NYFKMSKRMYPHRPVMMVISHAAPHGPEDSAPQFSKLYPNASQHITPSYN  170
                                                  201
NYFKMSKRMYPHRPVMMVISHAAPHGPEDSAPQFSKLYPNASQHITPSYN  250  ...  171

YAPNMDKHWIMQYTGPMLPIHMEFTNILQRKRLQTLMSVDDSVERLYNML  220
                                                  251
YAPNMDKHWIMQYTGPMLPIHMEFTNILQRKRLQTLMSVDDSVERLYNML  300  ...  221

VETGELENTYIIYTADHGYHIGQFGLVKGKSMPYDFDIRVPFFIRGPSVE  270
                                                  301
VETGELENTYIIYTADHGYHIGQFGLVKGKSMPYDFDIRVPFFIRGPSVE  350  ...  271

PGSIVPQIVLNIDLAPTILDIAGLDTPPDVDGKSVLKLLDPEKPGNRFRT  320
                                                  351
PGSIVPQIVLNIDLAPTILDIAGLDTPPDVDGKSVLKLLDPEKPGNRFRT  400  ...  321

NKKAKIWRDTPFLVERGKFLRKKEESSKNIQQSNHLPKYERVKELCQQARY 370
```

-continued

```
                                        401
|||||||||||||||||||||||||||||||||||||||||||||||||
NKKAKIWRDTFLVERGKFLRKKEESSKNIQQSNHLPKYERVKELCQQARY  450 . . . 371

QTACEQPGQKWQCIEDTSGKLRIHKCKGPSDLLTVRQSTRNLYARGFHDK  420
                                        451
|||||||||||||||||||||||||||||||||||||||||||||||||
QTACEQPGQKWQCIEDTSGKLRIHKCKGPSDLLTVRQSTRNLYARGFHDK  500 . . . 421

DKECSCRESGYRASRSQRKSQRQFLRNQGTPKYKPRFVHTRQTRSLSVEF  470
                                        501
|||||||||||||||||||||||||||||||||||||||||||||||||
DKECSCRESGYRASRSQRKSQRQFLRNQGTPKYKPRFVHTRQTRSLSVEF  550 . . . 471

EGEIYDINLEEEEELQVLQPRNIAKRHDEGHKGPRDLQASSGGNRGRMLA  520
                                        551
|||||||||||||||||||||||||||||||||||||||||||||||||
EGEIYDINLEEEEELQVLQPRNIAKRHDEGHKGPRDLQASSGGNRGRMLA  600 . . . 521

DSSNAVGPPTTVRVTHKCFILPNDSIHCERELYQSARAWKDHKAYIDKEI  570
                                        601
|||||||||||||||||||||||||||||||||||||||||||||||||
DSSNAVGPPTTVRVTHKCFILPNDSIHCERELYQSARAWKDHKAYIDKEI  650 . . . 571

EALQDKIKNLREVRGHLKRRKPEECSCSKQSYYNKEKGVKKQEKLKSHLH  620
                                        651
|||||||||||||||||||||||||||||||||||||||||||||||||
EALQDKIKNLREVRGHLKRRKPEECSCSKQSYYNKEKGVKKQEKLKSHLH  700 . . . 621

PFKEAAQEVDSKLQLFKENNRRRKKERKEKRRQRKGEECSLPGLTCFTHD  670
                                        701
|||||||||||||||||||||||||||||||||||||||||||||||||
PFKEAAQEVDSKLQLFKENNRRRKKERKEKRRQRKGEECSLPGLTCFTHD  750 . . . 671

NNHWQTAPFWNLGSFCACTSSNNNTYWCLRTVNETHNFLFCEFATGFLEY  720
                                        751
|||||||||||||||||||||||||||||||||||||||||||||||||
NNHWQTAPFWNLGSFCACTSSNNNTYWCLRTVNETHNFLFCEFATGFLEY  800 . . . 721

FDMNTDPYQLTNTVHTVERGILNQLHVQLMELRSCQGYKQCNPRPKNLDV  770
                                        801
|||||||||||||||||||||||||||||||||||||||||||||||||
FDMNTDPYQLTNTVHTVERGILNQLHVQLMELRSCQGYKQCNPRPKNLDV  850 . . . 771

GNKDGGSYDLHRGQLWDGWEG                               791
                                        851
|||||||||||||||||||||
GNKDGGSYDLHRGQLWDGWEG                               871
```

Sequence name: /tmp/AVAZGWHuF0/RzHFOnHIsT: SUL1_HUMAN (SEQ ID NO:96)
Sequence documentation:
Alignment of: Z21368_PEA.sub.--1_P15 (SEQ ID NO:99).times.SUL1_HUMAN (SEQ ID NO:96).

Alignment segment 1/1: TABLE-US-00237 Quality: 4174.00 Escore: 0 Matching length: 416 Total length: 416 Matching Percent 100.00 Matching Percent Identity: 100.00 Similarity: Total Percent Similarity: 100.00 Total Percent Identity: 100.00 Gaps: 0

```
Alignment: TABLE-US-00238 . . . 1
MKYSCCALVLAVLGTELLGSLCSTVRSPRFRGRIQQERKNIRPNIILVLT  50
                                        1
|||||||||||||||||||||||||||||||||||||||||||||||||
MKYSCCALVLAVLGTELLGSLCSTVRSPRFRGRIQQERKNIRPNIILVLT  50 . . . 51

DDQDVELGSLQVMNKTRKIMEHGGATFINAFVTTPMCCPSRSSMLTGKYV  100
                                        51
|||||||||||||||||||||||||||||||||||||||||||||||||
DDQDVELGSLQVMNKTRKIMEHGGATFINAFVTTPMCCPSRSSMLTGKYV  100 . . . 101

HNHNVYTNNENCSSPSWQAMHEPRTFAVYLNNTGYRTAFFGKYLNEYNGS  150
                                        101
|||||||||||||||||||||||||||||||||||||||||||||||||
HNHNVYTNNENCSSPSWQAMHEPRTFAVYLNNTGYRTAFFGKYLNEYNGS  150 . . . 151

YIPPGWREWLGLIKNSRFYNYTVCRNGIKEKHGFDYAKDYFTDLITNESI  200
                                        151
|||||||||||||||||||||||||||||||||||||||||||||||||
YIPPGWREWLGLIKNSRFYNYTVCRNGIKEKHGFDYAKDYFTDLITNESI  200 . . . 201

NYFKMSKRMYPHRPVMMVISHAAPHGPEDSAPQFSKLYPNASQHITPSYN  250
                                        201
|||||||||||||||||||||||||||||||||||||||||||||||||
NYFKMSKRMYPHRPVMMVISHAAPHGPEDSAPQFSKLYPNASQHITPSYN  250 . . . 251

YAPNMDKHWIMQYTGPMLPIHMEFTNILQRKRLQTLMSVDDSVERLYNML  300
                                        251
|||||||||||||||||||||||||||||||||||||||||||||||||
YAPNMDKHWIMQYTGPMLPIHMEFTNILQRKRLQTLMSVDDSVERLYNML  300 . . . 301

VETGELENTYIIYTADHGYHIGQFGLVKGKSMPYDFDIRVPFFIRGPSVE  350
                                        301
|||||||||||||||||||||||||||||||||||||||||||||||||
VETGELENTYIIYTADHGYHIGQFGLVKGKSMPYDFDIRVPFFIRGPSVE  350 . . . 351

PGSIVPQIVLNIDLAPTILDIAGLDTPPDVDGKSVLKLLDPEKPGNRFRT  400
```

```
                                                                351
PGSIVPQIVLNIDLAPTILDIAGLDTPPDVDGKSVLKLLDPEKPGNRFRT  400 . . . 401

NKKAKIWRDTFLVERG                                    416
||||||||||||||||                                    401
NKKAKIWRDTFLVERG                                    416
```

Sequence name: /tmp/JhwgRdKqmt/kqSmjxkWWk: SUL1_HUMAN (SEQ ID NO:96)

Sequence documentation:

Alignment of: Z21368_PEA.sub.--1_P16 (SEQ ID NO:100).times.SUL1_HUMAN (SEQ ID NO:96).

Alignment segment 1/1: TABLE-US-00239 Quality: 3985.00 Escore: 0 Matching length: 397 Total length: 397 Matching Percent 100.00 Matching Percent Identity: 100.00 Similarity: Total Percent Similarity: 100.00 Total Percent Identity: 100.00 Gaps: 0

Sequence name: /tmp/GPInIw3BOg/zXFdxqG4ow: SUL1_HUMAN (SEQ ID NO:96)

Sequence documentation:

Alignment of: Z21368_PEA.sub.--1_P22 (SEQ ID NO:101).times.SUL1_HUMAN (SEQ ID NO:96).

Alignment segment 1/1: TABLE-US-00241 Quality: 1897.00 Escore: 0 Matching length: 188 Total length: 188

```
Alignment: TABLE-US-00240 . . . 1
MKYSCCALVLAVLGTELLGSLCSTVRSPRFRGRIQQERKNIRPNIILVLT    50
|||||||||||||||||||||||||||||||||||||||||||||||||     1
MKYSCCALVLAVLGTELLGSLCSTVRSPRFRGRIQQERKNIRPNIILVLT    50 . . . 51

DDQDVELGSLQVMNKTRKIMEHGGATFINAFVTTPMCCPSRSSMLTGKYV   100
|||||||||||||||||||||||||||||||||||||||||||||||||    51
DDQDVELGSLQVMNKTRKIMEHGGATFINAFVTTPMCCPSRSSMLTGKYV   100 . . . 101

HNHNVYTNNENCSSPSWQAMHEPRTFAVYLNNTGYRTAFFGKYLNEYNGS   150
|||||||||||||||||||||||||||||||||||||||||||||||||   101
HNHNVYTNNENCSSPSWQAMHEPRTFAVYLNNTGYRTAFFGKYLNEYNGS   150 . . . 151

YIPPGWREWLGLIKNSRFYNYTVCRNGIKEKHGFDYAKDYFTDLITNESI   200
|||||||||||||||||||||||||||||||||||||||||||||||||   151
YIPPGWREWLGLIKNSRFYNYTVCRNGIKEKHGFDYAKDYFTDLITNESI   200 . . . 201

NYFKMSKRMYPHRPVMMVISHAAPHGPEDSAPQFSKLYPNASQHITPSYN   250
|||||||||||||||||||||||||||||||||||||||||||||||||   201
NYFKMSKRMYPHRPVMMVISHAAPHGPEDSAPQFSKLYPNASQHITPSYN   250 . . . 251

YAPNMDKHWIMQYTGPMLPIHMEFTNILQRKRLQTLMSVDDSVERLYNML   300
|||||||||||||||||||||||||||||||||||||||||||||||||   251
YAPNMDKHWIMQYTGPMLPIHMEFTNILQRKRLQTLMSVDDSVERLYNML   300 . . . 301

VETGELENTYIIYTADHGYHIGQFGLVKGKSMPYDFDIRVPFFIRGPSVE   350
|||||||||||||||||||||||||||||||||||||||||||||||||   301
VETGELENTYIIYTADHGYHIGQFGLVKGKSMPYDFDIRVPFFIRGPSVE   350 . . . 351

PGSIVPQIVLNIDLAPTILDIAGLDTPPDVDGKSVLKLLDPEKPGNR      397
||||||||||||||||||||||||||||||||||||||||||||||      351
PGSIVPQIVLNIDLAPTILDIAGLDTPPDVDGKSVLKLLDPEKPGNR      397
```

Matching Percent 100.00 Matching Percent Identity: 100.00 Similarity: Total Percent Similarity: 100.00 Total Percent Identity: 100.00 Gaps: 0

```
Alignment: TABLE-US-00242 . . . 1
MKYSCCALVLAVLGTELLGSLCSTVRSPRFRGRIQQERKNIRPNIILVLT    50
|||||||||||||||||||||||||||||||||||||||||||||||||     1
MKYSCCALVLAVLGTELLGSLCSTVRSPRFRGRIQQERKNIRPNIILVLT    50 . . . 51

DDQDVELGSLQVMNKTRKIMEHGGATFINAFVTTPMCCPSRSSMLTGKYV   100
|||||||||||||||||||||||||||||||||||||||||||||||||    51
DDQDVELGSLQVMNKTRKIMEHGGATFINAFVTTPMCCPSRSSMLTGKYV   100 . . . 101

HNHNVYTNNENCSSPSWQAMHEPRTFAVYLNNTGYRTAFFGKYLNEYNGS   150
|||||||||||||||||||||||||||||||||||||||||||||||||   101
HNHNVYTNNENCSSPSWQAMHEPRTFAVYLNNTGYRTAFFGKYLNEYNGS   150 . . . 151

YIPPGWREWLGLIKNSRFYNYTVCRNGIKEKHGFDYAK                188
|||||||||||||||||||||||||||||||||||||                151
YIPPGWREWLGLIKNSRFYNYTVCRNGIKEKHGFDYAK                188
```

Sequence name: /tmp/oji5Fs74fB/8xeB9KrGjp:Q7Z2W2 (SEQ ID NO:840)
Sequence documentation:
Alignment of: Z21368_PEA.sub.--1_P23 (SEQ ID NO:102).times.Q7Z2W2 (SEQ ID NO:840).
Alignment segment 1/1: TABLE-US-00243 Quality: 1368.00 Escore: 0.000511 Matching length: 137 Total length: 137 Matching Percent 100.00 Matching Percent 100.00 Similarity: Identity: Total Percent Similarity: 100.00 Total Percent Identity: 100.00 Gaps: 0

```
Alignment: TABLE-US-00244 . . . 1
MKYSCCALVLAVLGTELLGSLCSTVRSPRFRGRIQQERKNIRPNIILVLT   50
|||||||||||||||||||||||||||||||||||||||||||||||||   1
MKYSCCALVLAVLGTELLGSLCSTVRSPRFRGRIQQERKNIRPNIILVLT   50 . . . 51

DDQDVELGSLQVMNKTRKIMEHGGATFINAFVTTPMCCPSRSSMLTGKYV  100
|||||||||||||||||||||||||||||||||||||||||||||||||   51
DDQDVELGSLQVMNKTRKIMEHGGATFINAFVTTPMCCPSRSSMLTGKYV  100 . . . 101

HNHNVYTNNENCSSPSWQAMHEPRTFAVYLNNTGYRT               137
||||||||||||||||||||||||||||||||||||               101
HNHNVYTNNENCSSPSWQAMHEPRTFAVYLNNTGYRT               137
```

Sequence name: /tmp/oji5Fs74fB/8xeB9KrGjp:SUL1_HUMAN (SEQ ID NO:96)
Sequence documentation:
Alignment of: Z21368_PEA.sub.--1_P23 (SEQ ID NO:102).times.SUL1_HUMAN (SEQ ID NO:96).
Alignment segment 1/1: TABLE-US-00245 Quality: 1368.00 Escore: 0.000511 Matching length: 137 Total length: 137 Matching Percent 100.00 Matching Percent 100.00 Similarity: Identity: Total Percent Similarity: 100.00 Total Percent Identity: 100.00 Gaps: 0

```
Alignment: TABLE-US-00246 . . . 1
MKYSCCALVLAVLGTELLGSLCSTVRSPRFRGRIQQERKNIRPNIILVLT   50
|||||||||||||||||||||||||||||||||||||||||||||||||   1
MKYSCCALVLAVLGTELLGSLCSTVRSPRFRGRIQQERKNIRPNIILVLT   50 . . . 51

DDQDVELGSLQVMNKTRKIMEHGGATFINAFVTTPMCCPSRSSMLTGKYV  100
|||||||||||||||||||||||||||||||||||||||||||||||||   51
DDQDVELGSLQVMNKTRKIMEHGGATFINAFVTTPMCCPSRSSMLTGKYV  100 . . . 101

HNHNVYTNNENCSSPSWQAMHEPRTFAVYLNNTGYRT               137
||||||||||||||||||||||||||||||||||||               101
HNHNVYTNNENCSSPSWQAMHEPRTFAVYLNNTGYRT               137
```

Expression of SUL1_HUMAN--Extracellular Sulfatase Sulf-1 Z21368 Transcripts which are Detectable by Amplicon as Depicted in Sequence Name Z21368seg39 (SEQ ID NO:844) in Normal and Cancerous Breast Tissues Expression of SUL1_HUMAN--Extracellular sulfatase Sulf-1 transcripts detectable by or according to seg39, Z21368seg39 (SEQ ID NO:844) amplicon and Z21368seg39F (SEQ ID NO:842) and Z21368seg39R (SEQ ID NO:843) primers was measured by real time PCR. In parallel the expression of four housekeeping genes--PBGD (GenBank Accession No. BC019323 (SEQ ID NO:926), amplicon--PBGD-amplicon (SEQ ID NO:929)), HPRT1 (GenBank Accession No. NM.sub.--000194 (SEQ ID NO:930); amplicon--HPRT1-amplicon (SEQ ID NO:933)), SDHA (GenBank Accession No. NM.sub.--004168 (SEQ ID NO:922); amplicon--SDHA-amplicon (SEQ ID NO:925)), and G6PD (GenBank Accession No. NM.sub.--000402 (SEQ ID NO:918); G6PD-amplicon (SEQ ID NO:921)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60,63-67, Table 1 above, Tissue samples in testing panel), to obtain a value of fold up-regulation for each sample relative to median of the normal PM samples.

Figure 13:
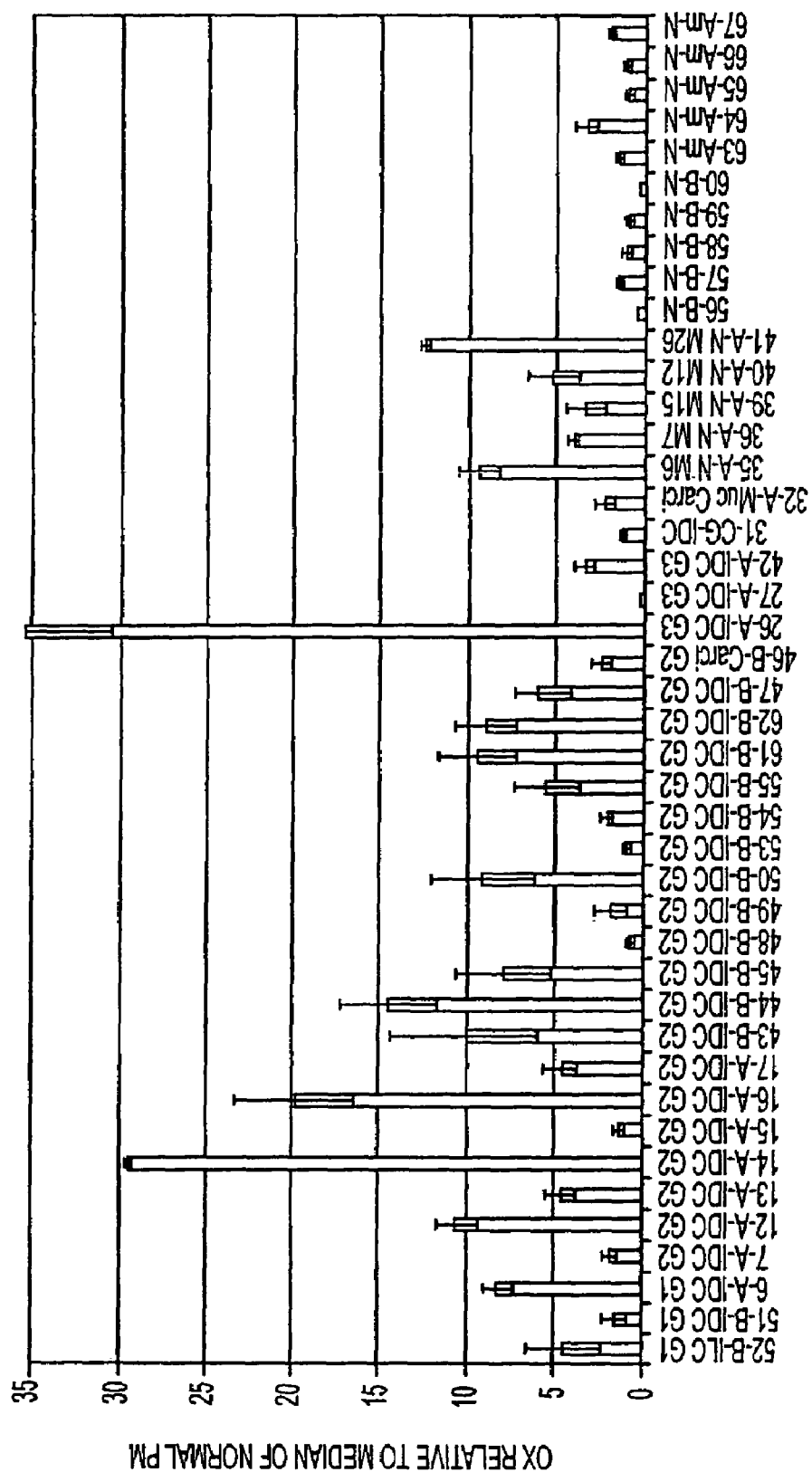
FIG. 13 is a histogram showing the expression of SUL1_HUMAN—Extracellular sulfatase Sulf-1Z21368 transcripts, which are detectable by amplicon as depicted in sequence name Z21368seg39 (SEQ ID NO:844), in normal and cancerous breast tissues.

FIG. 13 is a histogram showing over expression of the above-indicated SUL1_HUMAN—Extracellular sulfatase Sulf-1 transcripts in cancerous breast samples relative to the normal samples. Values represent the average of duplicate experiments. Error bars indicate the minimal and maximal values obtained. The number and percentage of samples that exhibit at least 5-fold over-expression, out of the total number of samples tested is indicated in the bottom.

As is evident from FIG. 13, the expression of SUL1_HUMAN--Extracellular sulfatase Sulf-1 transcripts detectable by the above amplicon(s) in cancer samples was significantly higher than in the non-cancerous samples (Sample Nos 56-60,63-67, Table 1 above, Tissue samples in testing panel). Notably an over-expression of at least 5 fold was found in 13 out of 28 adenocarcinoma samples.

Statistical analysis was applied to verify the significance of these results, as described below.

The P value for the difference in the expression levels of SUL1_HUMAN--Extracellular sulfatase Sulf-1 transcripts detectable by the above amplicon(s) in breast cancer samples versus the normal tissue samples was determined by T test as 2.14E-03.

Threshold of 5 fold overexpression was found to differentiate between cancer and normal samples with P value of 6.91 E-03 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: Z21368seg39F forward primer (SEQ ID NO:842); Z21368seg39R reverse primer (SEQ ID NO:843).

The present invention also preferably encompasses any amplicon obtained through the use of any suitable primer pair; for example, for the above experiment, the following amplicon was obtained as a non-limiting illustrative example only of a suitable amplicon: Z21368seg39 (SEQ ID NO:844). TABLE-US-00247 Z21368seg39F (SEQ ID NO: 842)-GTTGCATTTCTCAGTGCTGGTTT Z21368seg39R (SEQ ID NO: 843)-AGGGTGCCGGGTGAGG Z21368seg39 (SEQ ID NO: 844)-GTTGCATTTCTCAGTGCTGGTTTCTMTCAGACCAGTGGATTGAGTTTCTCTACCATC CTCCCCACGTTCTTCTCTMGCTGCCTCCAAGCCTCACCCGGCACCCT Expression of SUL1_HUMAN--Extracellular Sulfatase Sulf-1Z21368 Transcripts which are Detectable by Amplicon as Depicted in Sequence Name Z21368seg39 (SEQ ID NO:844) in Different Normal Tissues Expression of SUL1_HUMAN--Extracellular sulfatase Sulf-1 transcripts detectable by or according to Z21368seg39 (SEQ ID NO:844) amplicon and Z21368seg39F (SEQ ID NO:842) Z21368seg39R (SEQ ID NO:843) was measured by real time PCR. In parallel the expression of four housekeeping genes--[RPL19 (GenBank Accession No. NM.sub.--000981 (SEQ ID NO:934); RPL1 9 amplicon (SEQ ID NO:937)), TATA box (GenBank Accession No. NM.sub.--003194 (SEQ ID NO:938); TATA amplicon (SEQ ID NO:941)), UBC (GenBank Accession No. BC000449 (SEQ ID NO:942); amplicon--Ubiquitin-amplicon (SEQ ID NO:945)) and SDHA (GenBank Accession No. NM.sub.--004168 (SEQ ID NO:922); amplicon--SDHA-amplicon (SEQ ID NO:925)) was measured similarly. For each RT sample, the expression of the above amplicon was normalized to the geometric mean of the quantities of the housekeeping genes. The normalized quantity of each RT sample was then divided by the median of the quantities of the breast samples (sample nos. 33-35 in table 2 "Tissue samples in normal panel") to obtain a value of relative expression of each sample relative to median of the Normal samples. Primers and amplicon are as above.

Figure 14:
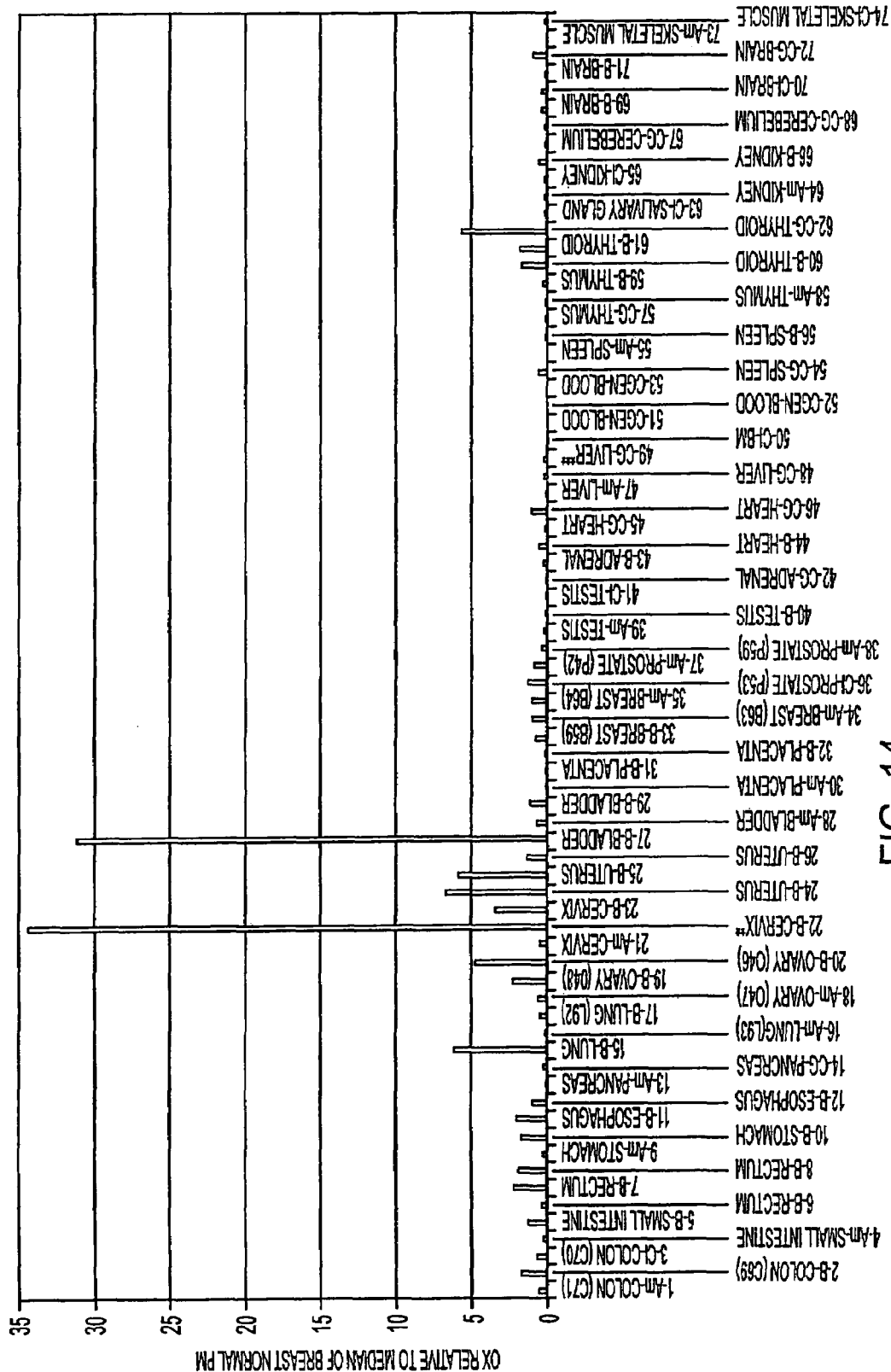
FIG. 14 is a histogram showing the expression of SUL1_HUMAN—Extracellular sulfatase Sulf-1Z21368 transcripts, which are detectable by amplicon as depicted in sequence name Z21368seg39 (SEQ ID NO:844), in different normal tissues.

The results are presented in FIG. 14, demonstrating the expression of SUL1_HUMAN—Extracellular sulfatase Sulf-1Z21368 transcripts, which are detectable by amplicon as depicted in sequence name Z21368seg39 (SEQ ID NO:844), in different normal tissues.

Expression of SUL1_HUMAN--Extracellular Sulfatase Sulf-1Z21368 Transcripts which are Detectable by Amplicon as Depicted in Sequence Name Z21368junc17-21 (SEQ ID NO:847) in Normal and Cancerous Breast Tissues Expression of SUL1_HUMAN--Extracellular sulfatase Sulf-1 transcripts detectable by or according to Z21368junc17-21 (SEQ ID NO:847) amplicon and Z21368junc17-21F (SEQ ID NO:845) and Z21368junc17-21 R (SEQ ID NO:846) primers was measured by real time PCR. In parallel the expression of four housekeeping genes--PBGD (GenBank Accession No. BC019323 (SEQ ID NO:926); amplicon--PBGD-amplicon (SEQ ID NO:929)), HPRT1 (GenBank Accession No. NM.sub.--000194 (SEQ ID NO:930); amplicon--HPRT1-amplicon (SEQ ID NO:933)), and SDHA (GenBank Accession No. NM.sub.--004168 (SEQ ID NO:922); amplicon--SDHA-amplicon (SEQ ID NO:925)), G6PD (GenBank Accession No. NM.sub.--000402 (SEQ ID NO:918); G6PD-amplicon (SEQ ID NO:921)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos 56-60,63-67 Table 1 above, "Tissue samples in testing panel"), to obtain a value of fold up-regulation for each sample relative to median of the normal PM samples.

Figure 15:
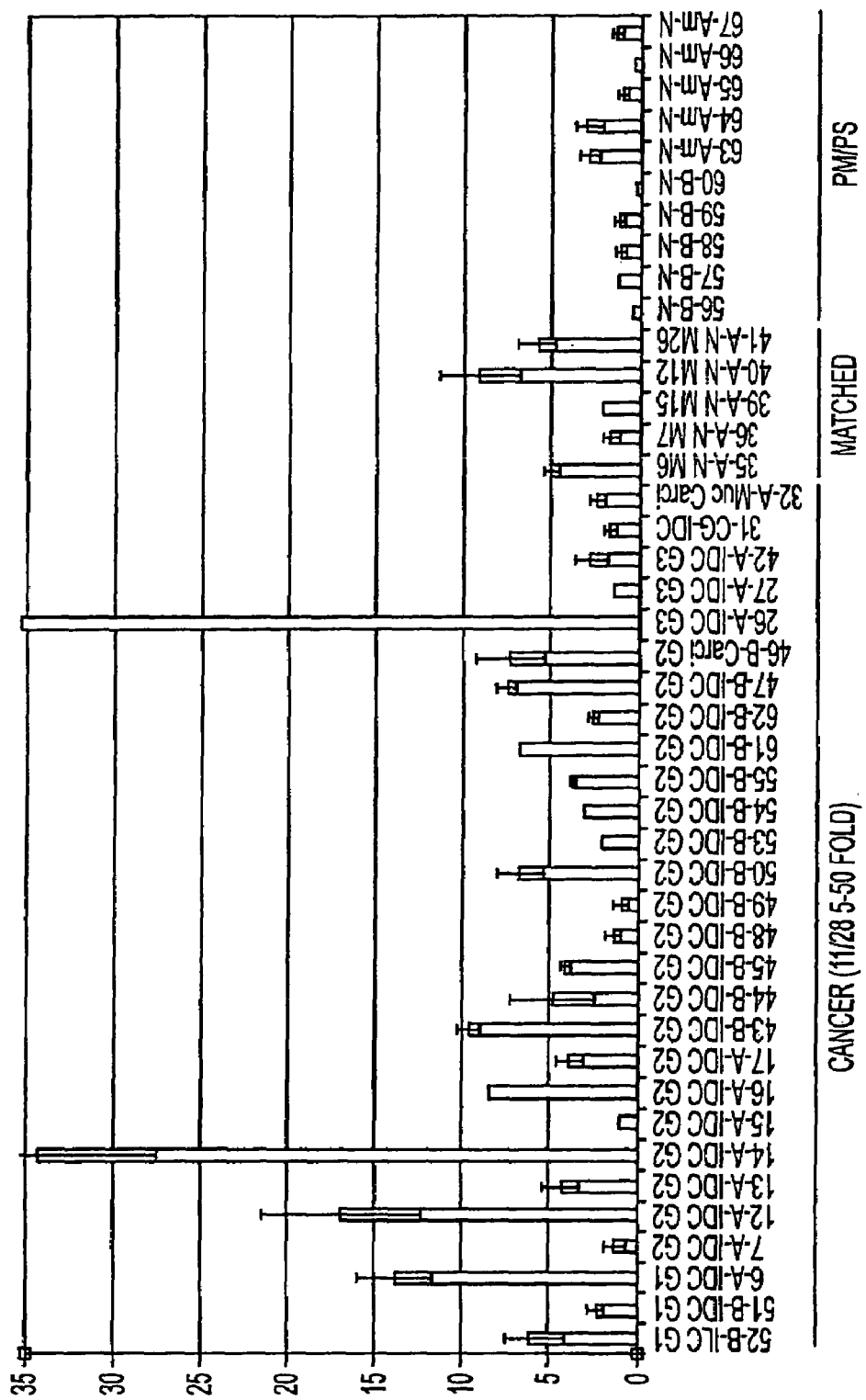
FIG. 15 is a histogram showing the expression of SUL1_HUMAN—Extracellular sulfatase Sulf-1Z21368 transcripts which are detectable by amplicon as depicted in sequence name Z21368junc17-21 (SEQ ID NO:847) in normal and cancerous breast tissues.

FIG. 15 is a histogram showing over expression of the above-indicated SUL1_HUMAN—Extracellular sulfatase Sulf-1 transcripts in cancerous breast samples relative to the normal samples. Values represent the average of duplicate experiments. Error bars indicate the minimal and maximal values obtained. The number and percentage of samples that exhibit at least 5 fold over-expression, out of the total number of samples tested is indicated in the bottom.

As is evident from FIG. 15, the expression of SUL1_HUMAN--Extracellular sulfatase Sulf-1 transcripts detectable by the above amplicon(s) in cancer samples was significantly higher than in the non-cancerous samples (Sample Nos 56-60,63-67, Table 1 above, Tissue samples in testing panel). Notably an over-expression of at least 5 fold was found in 11 out of 28 adenocarcinoma samples.

Statistical analysis was applied to verify the significance of these results, as described below.

The P value for the difference in the expression levels of SUL1_HUMAN--Extracellular sulfatase Sulf-1 transcripts detectable by the above amplicon(s) in breast cancer samples versus the normal tissue samples was determined by T test as 4.6E-03.

Threshold of 5 fold overexpression was found to differentiate between cancer and normal samples with P value of 1.78E-02 as checked by exact fisher test. The above values demonstrate statistical significance of the results. Primer pairs are also optionally and preferably encompassed within the present invention; for example, for the above experiment, the following primer pair was used as a non-limiting illustrative example only of a suitable primer pair: Z21368junc17-21F forward primer (SEQ ID NO:845); Z21368junc17-21R reverse primer (SEQ ID NO:846).

The present invention also preferably encompasses any amplicon obtained through the use of any suitable primer pair; for example, for the above experiment, the following amplicon was obtained as a non-limiting illustrative example only of a suitable amplicon: Z21368junc17-21 (SEQ ID NO:847) TABLE-US-00248 Z21368junc17-21F (SEQ ID NO: 845)-GGACGGATACAGCAGGMCG Z21368junc17-21R (SEQ ID NO: 846)-TATTTTCCAAAAAAGGCCAGCTC Z21368junc17-21 (SEQ ID NO: 847)-GGACGGATACAGCAGGAACGAAAAAACATCCGACCCMCATTATTCTTGTGCTTAC CGATGATCMGATGTGGAGCTGGCCTTTTTTGGAAAATA Expression of SUL1_HUMAN--Extracellular Sulfatase Sulf-1 Z21368 Transcripts which are Detectable by Amplicon as Depicted in Sequence Name Z21368junc17-21 (SEQ ID NO:847) in Different Normal Tissues Expression of SUL1_HUMAN--Extracellular sulfatase Sulf-1 Z21368 transcripts detectable by or according to amplicon Z21368junc17-21 (SEQ ID NO:847) was measured by real time PCR. In parallel the expression of four housekeeping genes--RPL19 (GenBank Accession No. NM.sub.--000981 (SEQ ID NO:934); RPL19 amplicon (SEQ ID NO:937)), TATA box (GenBank Accession No. NM.sub.--003194 (SEQ ID NO:938); TATAamplicon (SEQ ID NO:941)), UBC (GenBank Accession No. BC000449 (SEQ ID NO:942); amplicon--Ubiquitin-amplicon (SEQ ID NO:945)) and SDHA (GenBank Accession No. NM.sub.--004168 (SEQ ID NO:922); amplicon--SDHA-amplicon (SEQ ID NO:925)) was measured similarly. For each RT sample, the expression of the above amplicon was normalized to the geometric mean of the quantities of the housekeeping genes, as above. The normalized quantity of each RT sample was then divided by the median of the quantities of the breast samples (Sample Nos.—33-35 Table 2 above, "Tissue samples on normal panel"), to obtain a value of relative expression of each sample relative to median of the breast samples. Primers and amplicon are as above.

Figure 16:
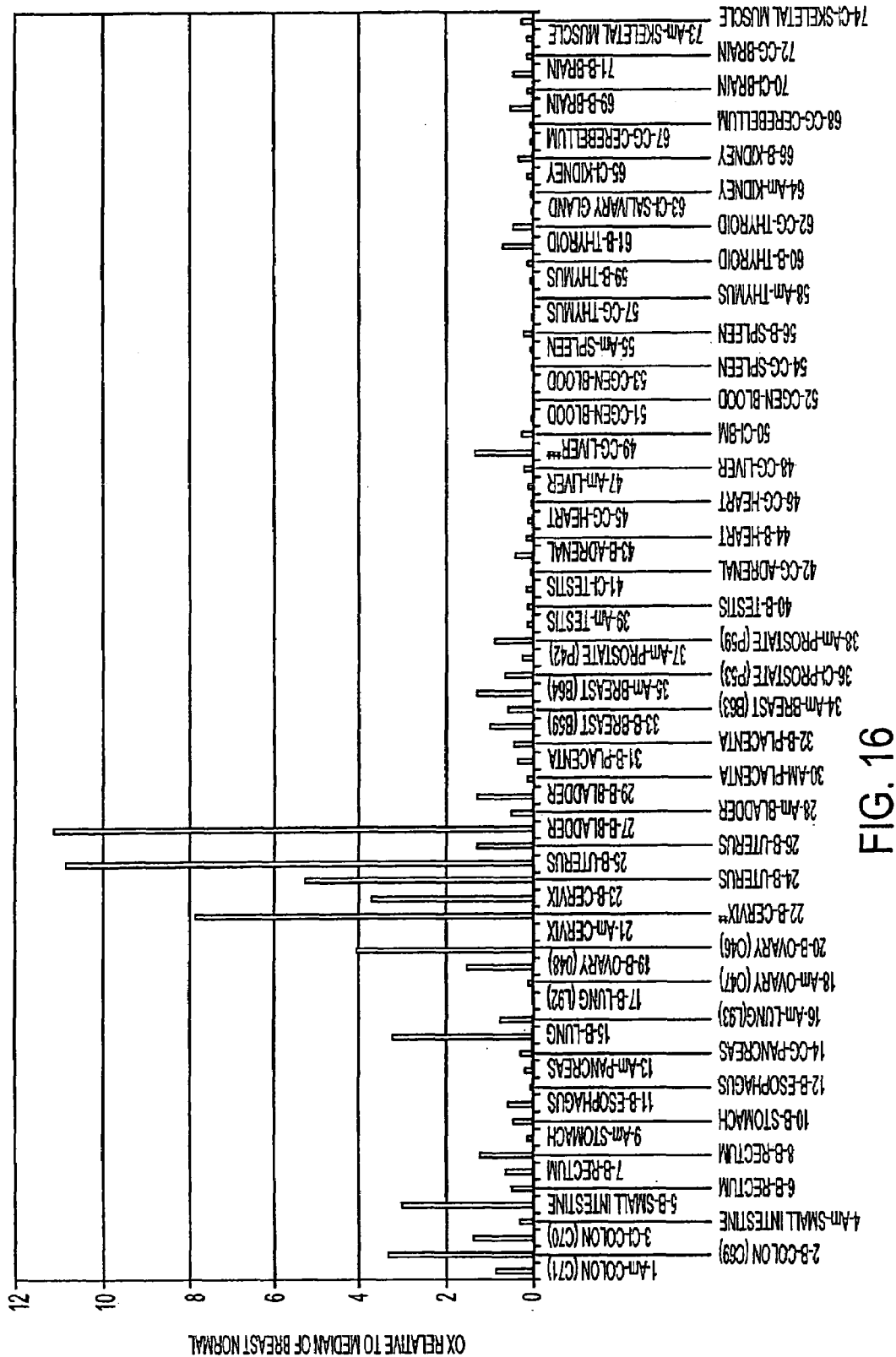
FIG. 16 is a histogram showing the expression of SUL1_HUMAN—Extracellular sulfatase Sulf-1 Z21368 transcripts, which are detectable by amplicon as depicted in sequence name Z21368junc17-21, in different normal tissues.

The results are presented in FIG. 16, demonstrating the expression of SUL1_HUMAN—Extracellular sulfatase Sulf-1 Z21368 transcripts, which are detectable by amplicon as depicted in sequence name Z21368junc17-21 (SEQ ID NO:847), in different normal tissues.

Description for Cluster T59832

Cluster T59832 features 6 transcript(s) and 33 segment(s) of interest, the names for which are given in Tables 1 and 2, respectively, the sequences themselves are given at the end of the 5 application. The selected protein variants are given in table 3. TABLE-US-00249 TABLE 1 Transcripts of interest Transcript Name Sequence ID No T59832_T11 103 T59832_T15 104 T59832_T22 105 T59832_T28 106 T59832_T6 107 T59832_T8 108

TABLE-US-00250 TABLE 2 Segments of interest Segment Name Sequence ID No T59832_node_1 109 T59832_node_22 110 T59832_node_23 111 T59832_node_24 112 T59832_node_29 113 T59832_node_39 114 T59832_node_7 115 T59832_node_10 116 T59832_node_11 117 T59832_node_12 118 T59832_node_14 119 T59832_node_16 120 T59832_node_19 121 T59832_node_2 122 T59832_node_20 123 T59832_node_25 124 T59832_node_26 125 T59832_node_27 126 T59832_node_28 127 T59832_node_3 128 T59832_node_30 129 T59832_node_31 130 T59832_node_32 131 T59832_node_34 132 T59832_node_35 133 T59832_node_36 134 T59832_node_37 135 T59832_node_38 136 T59832_node_4 137 T59832_node_5 138 T59832_node_6 139 T59832_node_8 140 T59832_node_9 141

TABLE-US-00251 TABLE 3 Proteins of interest Protein Name Sequence ID No T59832_P5 143 T59832_P7 144 T59832_P9 145 T59832_P12 146 T59832_P18 147

These sequences are variants of the known protein Gamma-interferon inducible lysosomal thiol reductase precursor (SwissProt accession identifier GILT_HUMAN; known also according to the synonyms Gamma-interferon-inducible protein IP-30), SEQ ID NO: 142, referred to herein as the previously known protein.

Protein Gamma-interferon inducible lysosomal thiol reductase precursor (SEQ ID NO:142) is known or believed to have the following function(s): Cleaves disulfide bonds in proteins by reduction. May facilitate the complet unfolding of proteins destined for lysosomal degradation. May be involved in MHC class II-restricted antigen processing. The sequence for protein Gamma-interferon inducible lysosomal thiol reductase precursor (SEQ ID NO:142) is given at the end of the application, as "Gamma-interferon inducible lysosomal thiol reductase precursor (SEQ ID NO:142) amino acid sequence". Known polymorphisms for this sequence are as shown in Table 4. TABLE-US-00252 TABLE 4 Amino acid mutations for Known Protein SNP position(s) on amino acid sequence Comment 109 L→S 130 H→L Protein Gamma-interferon inducible lysosomal thiol reductase precursor (SEQ ID NO:142) localization is believed to be Lysosomal.

The following GO Annotation(s) apply to the previously known protein. The following annotation(s) were found: extracellular; lysosome, which are annotation(s) related to Cellular Component.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster T59832 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 17 refer to weighted expression of ESTs in each category, as "parts per million" (ratio of the expression of ESTs for a particular cluster to the expression of all ESTs in that category, according to parts per million).

Figure 17:
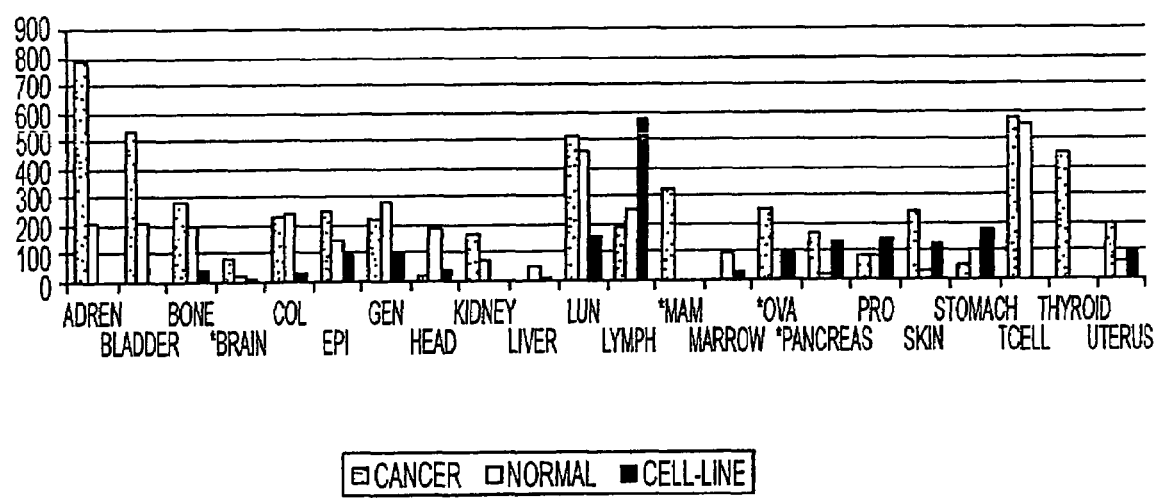
FIG. 17 is a histogram showing Cancer and cell-line vs. normal tissue expression for Cluster T59832, demonstrating overexpression in brain malignant tumors, breast malignant tumors, ovarian carcinoma and pancreas carcinoma.

Overall, the following results were obtained as shown with regard to the histograms in FIG. 17 and Table 5. This cluster is overexpressed (at least at a minimum level) in the following pathological conditions: brain malignant tumors, breast malignant tumors, ovarian carcinoma and pancreas carcinoma. TABLE-US-00253 TABLE 5 Normal tissue distribution Name of Tissue Number Adrenal 208 Bladder 205 Bone 200 Brain 18 Colon 236 Epithelial 143 General 280 head and neck 192 Kidney 71 Liver 53 Lung 459 lymph nodes 248 Breast 0 bone marrow 94 Ovary 0 Pancreas 20 Prostate 86 Skin 29 Stomach 109 T cells 557 Thyroid 0 Uterus 63

TABLE-US-00254 TABLE 6 P values and ratios for expression in cancerous tissue Name of Tissue P1 P2 SP1 R3 SP2 R4 adrenal 4.9e-01 5.9e-01 4.7e-03 1.1 2.9e-02 0.8 bladder 3.7e-01 5.6e-01 3.7e-02 1.3 2.5e-01 0.9 Bone 6.6e-01 6.7e-01 3.4e-01 0.6 9.1e-01 0.4 Brain 1.8e-01 2.9e-01 4.3e-03 3.8 2.8e-02 2.5 colon 4.4e-01 5.2e-01 6.1e-01 0.9 8.1e-01 0.7 epithelial 2.5e-02 1.6e-01 1.2e-05 1.6 9.8e-02 1.1 general 1.3e-02 1.6e-01 1 0.8 1 0.6 Head and neck 3.4e-01 3.3e-01 1 0.4 9.4e-01 0.5 kidney 7.7e-01 8.5e-01 1.4e-01 1.3 4.2e-01 0.9 Liver 8.3e-01 7.6e-01 1 0.5 1 0.6 Lung 5.7e-01 8.3e-01 3.5e-01 0.8 9.8e-01 0.5 lymph nodes 5.7e-01 6.6e-01 7.6e-01 0.8 3.6e-02 1.1 breast 5.0e-02 1.3e-01 2.5e-03 6.5 4.4e-02 3.6 Bone marrow 6.2e-01 7.8e-01 1 0.3 9.5e-01 0.5 ovary 2.2e-01 9.4e-02 3.2e-03 6.1 8.3e-03 5.3 pancreas 9.0e-02 1.6e-02 1.1e-03 4.0 7.9e-04 4.2 prostate 8.1e-01 8.0e-01 5.7e-01 0.9 4.1e-01 0.9 skin 1.6e-01 1.2e-01 2.3e-02 6.0 1.0e-02 2.2 stomach 5.5e-01 7.4e-01 9.4e-01 0.6 4.9e-01 1.0 T cells 1 6.7e-01 6.9e-01 1.0 9.8e-01 0.5 Thyroid 2.3e-01 2.3e-01 5.9e-02 2.5 5.9e-02 2.5 uterus 7.4e-02 4.7e-02 2.2e-02 2.0 6.2e-02 1.7

As noted above, cluster T59832 features 6 transcript(s), which were listed in Table 1 above. These transcript(s) encode for protein(s) which are variant(s) of protein Gamma-interferon inducible lysosomal thiol reductase precursor (SEQ ID NO:142). A description of each variant protein according to the present invention is now provided.

Variant protein T59832_P5 (SEQ ID NO:143) according to the present invention has an amino acid sequence as given at the end of the application; it is encoded by transcript(s) T59832_T6 (SEQ ID NO:107). An alignment is given to the known protein (Gamma-interferon inducible lysosomal thiol reductase precursor (SEQ ID NO:142)) at the end of the application. One or more alignments to one or more previously published protein sequences are given at the end of the application.

Comparison report between T59832_P5 (SEQ ID NO:143) and GILT_HUMAN (SEQ ID NO:142):

1. An isolated chimeric polypeptide encoding for T59832_P5 (SEQ ID NO:143), comprising a first amino acid sequence being at least 90% homologous to MTLSPLLL-FLPPLLLLLDVPTMVQASPLQALDFFGNGPPVNYK corresponding to amino acids 12-55 of GILT_HUMAN (SEQ ID NO:142), which also corresponds to amino acids 1-44 of T59832_P5 (SEQ ID NO:143), and a second amino acid sequence being at least 70%, optionally at least 80%, preferably at least 85%, more preferably at least 90% and most preferably at least 95% homologous to a polypeptide having the sequence VGTATGRAGWREQAPCRGTRLLL-SPQTSQGKTRAPRGRCPCRVPGKTLFSSRRCGHTP SVPFRFRIPHLRGAAASTRLVPPKGSM-SAYCVLLGQELGSPFVAQGTSSMGQGPPACIL AATLDAFIPARAGLACLWDLLGRCPRG (SEQ ID NO:1010) corresponding to amino acids 45-189 of T59832_P5 (SEQ ID NO:143), wherein said first and second amino acid sequences are contiguous and in a sequential order.

2. An isolated polypeptide encoding for a tail of T59832_P5 (SEQ ID NO:143), comprising a polypeptide being at least 70%, optionally at least about 80%, preferably at least about 85%, more preferably at least about 90% and most preferably at least about 95% homologous to the sequence TABLE-US-00255 VGTATGRAG-WREQAPCRGTRLLLSPQTSQGKTRA-PRGRCPCRVPGKTLFSSRRCGHTP (SEQ ID NO: 1010) SVPFRFRIPHLRGAAASTRLVPPKGSM-SAYCVLLGQELGSPFVAQGTSSMGQGPPACIL MTLDAFIPARAGLACLWDLLGRCPRG in T59832_P5. (SEQ ID NO: 143)

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T59832_P5 (SEQ ID NO:143) is encoded by the following transcript(s): T59832_T6 (SEQ ID NO:107), for which the sequence(s) is/are given at the end of the application. The coding portion of transcript T59832_T6 (SEQ ID NO:107) is shown in bold; this coding portion starts at position 149 and ends at position 715. The transcript also has the following SNPs as listed in Table 7 (given according to their position on the nucleotide sequence, with the alternative nucleic acid listed; the last column indicates whether the SNP is known or not; the presence of known SNPs in variant protein T59832_P5 (SEQ ID NO:143) sequence provides support for the deduced sequence of this variant protein according to the present invention). TABLE-US-00256 TABLE 7 Nucleic acid SNPs SNP position on Alternative Previously nucleotide sequence nucleic acid known SNP? 61 C→T Yes 148 G→T Yes 1505 G→C Yes 1651 T→No 1652 T→G Yes 1717 C→A No 1722 C→No 1722 C→G No 1752A→G Yes 1817A→G Yes 1854 C→No 1854 C→A No 212→A No 1871 C→T Yes 1886 T→G No 1906 G→A No 1906 G→C No 1942 C→No 1942 C→T No 1971 C→No 1986 G→A No 2001 G→T Yes 2008 A→No 241 G→T No 2030→T No 2031 C→T No 2050 C→No 2056 A→G Yes 2068 G→A Yes 2111 A→C Yes 2136 A→C Yes 2144 T→C Yes 244 A→G Yes 962 C→T Yes 1074 G→A Yes 1248 G→C Yes 1441 G→A Yes 1443 G→A No Variant protein T59832_P7 (SEQ ID NO:144) according to the present invention has an amino acid sequence as given at the end of the application; it is encoded by transcript(s) T59832_T8 (SEQ ID NO:108). An alignment is given to the known protein (Gamma-interferon inducible lysosomal thiol reductase precursor (SEQ ID NO:142) ) at the end of the application. One or more alignments to one or more previously published protein sequences are given at the end of the application. A brief description of the relationship of the variant protein according to the present invention to each such aligned protein is as follows:

Comparison report between T59832_P7 (SEQ ID NO:144) and GILT_HUMAN (SEQ ID NO:142):

1. An isolated chimeric polypeptide encoding for T59832_P7 (SEQ ID NO: 144), comprising a first amino acid sequence being at least 90% homologous to MTLSPLLL-FLPPLLLLLDVPTAAVQASPLQALDFF-GNGPPVNYKTGNLYLRGPLKKSNA PLVNVTLY-YEALCGGCRAFLIRELFPTWLLVMEILNVTLVPYGN AQEQNVSGRWEFKC QHGEEECKFNKVEACV-LDELDMELAFLTIVCMEEFEDMER-SLPLCLQLYAPGLSPDTIM ECAMGDRGMQLMHA-NAQRTDALQPPHEYVPWVTVNG corresponding to amino acids 12-223 of GILT_HUMAN (SEQ ID NO:142), which also corresponds to amino acids 1-212 of T59832-P7 (SEQ ID NO:144), and a second amino acid sequence being at least 70%, optionally at least 80%, preferably at least 85%, more preferably at least 90% and most preferably at least 95% homologous to a polypeptide having the sequence VRIFLA-LSLTLIVPWSQGWTRQRDQR (SEQ ID NO:1011) corresponding to amino acids 213-238 of T59832_P7 (SEQ ID NO:144), wherein said first and second amino acid sequences are contiguous and in a sequential order.

2. An isolated polypeptide encoding for a tail of T59832_P7 (SEQ ID NO:144), comprising a polypeptide being at least 70%, optionally at least about 80%, preferably at least about 85%, more preferably at least about 90% and most preferably at least about 95% homologous to the sequence VRIFLALSLTLIVPWSQGWTRQRDQR (SEQ ID NO:1011) in T59832_P7 (SEQ ID NO:144).

Comparison report between T59832_P7 (SEQ ID NO:144) and BAC98466 (SEQ ID NO:848):

1. An isolated chimeric polypeptide encoding for T59832_P7 (SEQ ID NO:144), comprising a first amino acid sequence being at least 90% homologous to MTLSPLLL-FLPPLLLLLDVPTAAVQASPLQALDFF-GNGPPVNYKTGNLYLRGPLKKSNA PLVNVTLY-YEALCGGCRAFLIRELFPTWLLVMEILNVTLVPYGN AQEQNVSGRWEFKC QHGEEECKFNKVEACV-LDELDMELAFLTIVCMEEFEDMER-SLPLCLQLYAPGLSPDTIM ECAMGDRGMQLMHA-NAQRTDALQPPHEYVPWVTVNG corresponding to amino acids 1-212 of BAC98466 (SEQ ID NO:848), which also corresponds to amino acids 1-212 of T59832_P7 (SEQ ID NO:144), and a second amino acid sequence being at least 70%, optionally at least 80%, preferably at least 85%, more preferably at least 90% and most preferably at least 95% homologous to a polypeptide having the sequence VRIFLA-LSLTLIVPWSQGWTRQRDQR (SEQ ID NO:1011) corresponding to amino acids 213-238 of T59832_P7 (SEQ ID NO:144), wherein said first and second amino acid sequences are contiguous and in a sequential order.

2. An isolated polypeptide encoding for a tail of T59832_P7 (SEQ ID NO:144), comprising a polypeptide being at least 70%, optionally at least about 80%, preferably at least about 85%, more preferably at least about 90% and most preferably at least about 95% homologous to the sequence VRIFLALSLTLIVPWSQGWTRQRDQR (SEQ ID NO:1011) in T59832_P7 (SEQ ID NO:144).

Comparison report between T59832_P7 (SEQ ID NO:144) and BAC85622 (SEQ ID NO:849):

1. An isolated chimeric polypeptide encoding for T59832_P7 (SEQ ID NO:144), comprising a first amino acid sequence being at least 70%, optionally at least 80%, preferably at least 85%, more preferably at least 90% and most preferably at least 95% homologous to a polypeptide having the sequence MTLSPLLLFLPPLLLLLDVPTAAVQAS-PLQALDFFGNGPPVNYKTGNLYLRGPLKKSNA PLVNVTLYYEALCGGCRAFLIRELFPTWLLV (SEQ ID NO:1012) corresponding to amino acids 1-90 of T59832_P7 (SEQ ID NO:144), and a second amino acid sequence being at least 90% homologous to MEILNVTLVPYGNAQEQN-VSGRWEFKCQHGEEECKFNKVEACV-LDELDMELAFLTIVC MEEFEDMERSLPLCLQ-LYAPGLSPDTIMECAMGDRGMQLMHANAQRTDAL QPPHEYV PWVTVNGVRIFLALSLTLIVPWSQG-WTRQRDQR corresponding to amino acids 1-148 of BAC85622 (SEQ ID NO:849), which also corresponds to amino acids 91-238 of T59832_P7 (SEQ ID NO:144), wherein said first and second amino acid sequences are contiguous and in a sequential order.

2. An isolated polypeptide encoding for a head of T59832_P7 (SEQ ID NO:144), comprising a polypeptide being at least 70%, optionally at least about 80%, preferably at least about 85%, more preferably at least about 90% and most preferably at least about 95% homologous to the sequence TABLE-US-00257 MTLSPLLLFLPPLLLLLD-VPTAAVQASPLQALDFFGNGPPVNYKT-GNLYLRGPLKKSNA (SEQ ID NO: 1012) PLVNVTLY-YEALCGGCRAFLIRELFPTWLLV of T59832_P7. (SEQ ID NO: 144)

Comparison report between T59832_P7 (SEQ ID NO:144) and Q8WU77 (SEQ ID NO:850):

1. An isolated chimeric polypeptide encoding for T59832_P7 (SEQ ID NO:144), comprising a first amino acid sequence being at least 90% homologous to MTLSPLLL-FLPPLLLLLDVPTMVQASPLQALDFF-GNGPPVNYKTGNLYLRGPLKKSNA PLVNVTLY-YEALCGGCRAFLIRELFPTWLLVMEILNVTLVPYGN AQEQNVSGRWEFKC QHGEEECKFNKVEACV-LDELDMELAFLTIVCMEEFEDMER-SLPLCLQLYAPGLSPDTIM ECAMGDRGMQLMHA-NAQRTDALQPPHEYVPWVTVNG corresponding to amino acids 1-212 of Q8WU77 (SEQ ID NO:850), which also corresponds to amino acids 1-212 of T59832_P7 (SEQ ID NO:144), and a second amino acid sequence being at least 70%, optionally at least 80%, preferably at least 85%, more preferably at least 90% and most preferably at least 95% homologous to a polypeptide having the sequence VRIFLA-LSLTLIVPWSQGWTRQRDQR (SEQ ID NO:1011) corresponding to amino acids 213-238 of T59832_P7 (SEQ ID NO:144), wherein said first and second amino acid sequences are contiguous and in a sequential order.

2. An isolated polypeptide encoding for a tail of T59832_P7 (SEQ ID NO:144), comprising a polypeptide being at least 70%, optionally at least about 80%, preferably at least about 85%, more preferably at least about 90% and most preferably at least about 95% homologous to the sequence VRIFLALSLTLIVPWSQGWTRQRDQR (SEQ ID NO:1011) in T59832_P7 (SEQ ID NO:144).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein T59832-P7 (SEQ ID NO:144) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein T59832_P7 (SEQ ID NO:144) sequence provides support for the deduced sequence of this variant protein according to the present invention). TABLE-US-00258 TABLE 8 Amino acid mutations SNP position(s) on Alternative Previously amino acid sequence amino acid(s) known SNP? 146 I→No 146 I→M Yes 168 P→Q No 170 L→No 170 L→V No 180 M→V Yes 76 R→Q Yes 77 A→T No Variant protein T59832_P7 (SEQ ID NO:144) is encoded by the following transcript(s): T59832_T8 (SEQ ID NO:108), for which the sequence(s) is/are given at the end of the application. The coding portion of transcript T59832_T8 (SEQ ID NO:108) is shown in bold; this coding portion starts at position 149 and ends at position 862. The transcript also has the following SNPs as listed in Table 9 (given according to their position on the nucleotide sequence, with the alternative nucleic acid listed; the last column indicates whether the SNP is known or not; the presence of known SNPs in variant protein T59832_P7 (SEQ ID NO:144) sequence provides support for the deduced sequence of this variant protein according to the present invention). TABLE-US-00259 TABLE 9 Nucleic acid SNPs SNP position on Alternative Previously nucleotide sequence nucleic known SNP? 61 C→T Yes 148 G→T Yes 651 C→A No 656 C→No 656 C→G No 686 A→G Yes 751 A→G Yes 1004 T→G Yes 1206 C→No 1206 C→A No 1223 C→T Yes 1238 T→G No 212→A No 1258 G→A No 1258 G→C No 1294 C→No 1294C→T No 1323 C→No 1338G→A No 1353G→T Yes 1360A→No 1382→T No 1383 C→T No 241 G→T No 1402 C→No 1408 A→G Yes 1420 G→A Yes 1463 A→C Yes 1488 A→C Yes 1496 T→C Yes 244 A→G Yes 375 G→A Yes 377 G→A 439 G→C Yes 585 T→No 586 T→G Yes Variant protein T59832_P9 (SEQ ID NO:145) according to the present invention has an amino acid sequence as given at the end of the application; it is encoded by transcript(s) T59832_T11 (SEQ ID NO:103). An alignment is given to the known protein (Gamma-interferon inducible lysosomal thiol reductase precursor (SEQ ID NO:142)) at the end of the application. One or more alignments to one or more previously published protein sequences are given at the end of the application. A brief description of the relationship of the variant protein according to the present invention to each such aligned protein is as follows:

Comparison report between T59832_P9 (SEQ ID NO:145) and GILT_HUMAN (SEQ ID NO:2):

1. An isolated chimeric polypeptide encoding for T59832_P9 (SEQ ID NO:145), comprising a first amino acid sequence being at least 90% homologous to MTLSPLLL-FLPPLLLLLDVPTMVQASPLQALDFF-GNGPPVNYKTGNLYLRGPLKKSNA PLVNVTLY-YEALCGGCRAFLIRELFPTWLLVMEILNVTLVPYGNA QEQNVSGRWEFKC QHGEEECKFNKVEACVLDELD-MELAFLTIVCMEEFEDMERSLPLCLQ-LYAPGLSPDTIM ECAMGDRGMQLMHANAQRT-DALQPPHE corresponding to amino acids 12-214 of GILT_HUMAN (SEQ ID NO:142), which also corresponds to amino acids 1-203 of T59832_P9 (SEQ ID NO:145), and a second amino acid sequence being at least 70%, optionally at least 80%, preferably at least 85%, more preferably at 90% and most preferably at least 95% homologous to a polypeptide having the sequence NPWKIRPSSLPLSASCTRARSRMSALPQPAPSGVFASSDGR (SEQ ID NO: 1013) corresponding to amino acids 204-244 of T59832_P9 (SEQ ID NO:145), wherein said first and second amino acid sequences are contiguous and in a sequential order.

2. An isolated polypeptide encoding for a tail of T59832_P9 (SEQ ID NO:145), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQPAPSGVFASSDGR (SEQ ID NO:1013) in T59832_P9 (SEQ ID NO:145).

Comparison report between-T59832_P9 (SEQ ID NO:145) and BAC98466 (SEQ ID NO:848):

1. An isolated chimeric polypeptide encoding for T59832_P9 (SEQ ID NO:145), comprising a first amino acid sequence being at least 90% homologous to MTLSPLLLFLPPLLLLLDVPTAAVQASPLQALDFFGNGPPVNYKTGNLYLRGPLKKSNA PLVNVTLYYEALCGGCRAFLIRELFPTWLLVMEILNVTLVPYGNAQEQNVSGRWEFKC QHGEEECKFNKVEACVLDELDMELAFLTIVCMEEFEDMERSLPLCLQLYAPGLSPDTIM ECAMGDRGMQLMHANAQRTDALQPPHE corresponding to amino acids 1-203 of BAC98466 (SEQ ID NO:848), which also corresponds to amino acids 1-203 of T59832_P9 (SEQ ID NO:145), and a second amino acid sequence being at least 70%, optionally at least 80%, preferably at least 85%, more preferably at least 90% and most preferably at least 95% homologous to a polypeptide having the sequence NPWKIRPSSLPLSASCTRARSRMSALPQPAPSGVFASSDGR (SEQ ID NO: 1013) corresponding to amino acids 204-244 of T59832_P9 (SEQ ID NO:145), wherein said first and second amino acid sequences are contiguous and in a sequential order.

2. An isolated polypeptide encoding for a tail of T59832_P9 (SEQ ID NO: 145), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQPAPSGVFASSDGR (SEQ ID NO:1013) in T59832_P9 (SEQ ID NO:145).

Comparison report between T59832_P9 (SEQ ID NO:145) and BAC85622 (SEQ ID NO:849):

1. An isolated chimeric polypeptide encoding for T59832_P9 (SEQ ID NO:145), comprising a first amino acid sequence being at least 70%, optionally at least 80%, preferably at least 85% more preferably at least 90% and most preferably at least 95% homologous to a polypeptide having the sequence MTLSPLLLFLPPLLLLLDVPTAAVQASPLQALDFFGNGPPVNYKTGNLYLRGPLKKSNA PLVNVTLYYEALCGGCRAFLIRELFPTWLLV (SEQ ID NO:1012) corresponding to amino acids 1-90 of T59832_P9 (SEQ ID NO:145), second amino acid sequence being at least 90% homologous to MEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHE corresponding to amino acids 1-113 of BAC85622 (SEQ ID NO:849), which also corresponds to amino acids 91-203 of T59832_P9 (SEQ ID NO:145), and a third amino acid sequence being at least 70%, optionally at least 80%, preferably at least 85%, more preferably at least 90% and most preferably at least 95% homologous to a polypeptide having the sequence NPWKIRPSSLPLSASCTRARSRMSALPQPAPSGVFASSDGR (SEQ ID NO:1013) corresponding to amino acids 204-244 of T59832_P9 (SEQ ID NO:145), wherein said first, second and third amino acid sequences are contiguous and in a sequential order.

2. An isolated polypeptide encoding for a head of T59832_P9 (SEQ ID NO:145), comprising a polypeptide being at least 70%, optionally at least about 80%, preferably at least about 85%, more preferably at least about 90% and most preferably at least about 95% homologous to the sequence TABLE-US-00260 MTLSPLLLFLPPLLLLLDVPTAAVQASPLQALDFFGNGPPVNYKTGNLYLRGPLKKSNA (SEQ ID NO: 1012) PLVNVTLYYEALCGGCRAFLIRELFPTWLLV of T59832_P9. (SEQ ID NO: 145)

3. An isolated polypeptide encoding for a tail of T59832_P9 (SEQ ID NO:145), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQPAPSGVFASSDGR (SEQ ID NO:1013) in T59832_P9 (SEQ ID NO:145).

Comparison report between T59832_P9 (SEQ ID NO:145) and Q8WU77 (SEQ ID NO:850):

1. An isolated chimeric polypeptide encoding for T59832_P9 (SEQ ID NO:145), comprising a first amino acid sequence being at least 90% homologous to MTLSPLLLFLPPLLLLLDVPTAAVQASPLQALDFFGNGPPVNYKTGNLYLRGPLKKSNA PLVNVTLYYEALCGGCRAFLIRELFPTWLLVMEILNVTLVPYGNAQEQNVSGRWEFKC QHGEEECKFNKVEACVLDELDMELAFLTIVCMEEFEDMERSLPLCLQLYAPGLSPDTIM ECAMGDRGMQLMHANAQRTDALQPPHE corresponding to amino acids 1-203 of Q8WU77 (SEQ ID NO:850), which also corresponds to amino acids 1-203 of T59832_P9 (SEQ ID NO:145), and a second amino acid sequence being at least 70%, optionally at least 80%, preferably at least 85%, more preferably at least 90% and most preferably at least 95% homologous to a polypeptide having the sequence TABLE-US-00261 (SEQ ID NO: 1013) NPWKIRPSSLPLSASCTRARSRMSALPQPAPSGVFASSDGR corresponding to amino acids 204-244 of T59832_P9 (SEQ ID NO:145), wherein said first and second amino acid sequences are contiguous and in a sequential order.

2. An isolated polypeptide encoding for a tail of T59832_P9 (SEQ ID NO:145), comprising a polypeptide being at least 70%, optionally at least about 80%, preferably at least about 85%, more preferably at least about 90% and most preferably at least about 95% homologous to the sequence NPWKIRPSSLPLSASCTRARSRMSALPQPAPSGVFASSDGR (SEQ ID NO:1013) in T59832_P9 (SEQ ID NO:145).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T59832_P9 (SEQ ID NO:145) also has the following non-silent SNPs (Single Nucleotide Polymorphisms) as listed in Table 10, (given according to their position(s) on the amino acid sequence, with the alternative amino acid(s) listed; the last column indicates whether the SNP is known or not; the presence of known SNPs in variant protein T59832_P9 SEQ ID NO:145) sequence provides support for the deduced sequence of this variant protein according to the present invention). TABLE-US-00262 TABLE 10 Amino acid mutations SNP position(s) on Alternative Previously amino acid sequence amino acid(s) known SNP? 146 I→No 146 I→M Yes 222 A→P No 222 A→T No 234 P→No 234 P→S No 243 G→No 76 R→Q Yes 77 A→T No 168 P→Q No 170 L→No 170 L→V No 180 M→V Yes 204 N→No 204 N→K No 210 P→L Yes 215 L→W No Variant protein T59832_P9 (SEQ ID NO:145) is encoded by the following transcript(s): T59832_T11 (SEQ ID NO:103), for which the sequence(s) is/are given at the end of the application. The coding portion of transcript T59832_T11 (SEQ ID NO:103) is shown in bold; this coding portion starts at position 149 and ends at position 880. The transcript also has the following SNPs as listed in Table 11 (given according to their position on the nucleotide sequence, with the alternative nucleic acid listed; the last column indicates whether the SNP is known or not; the presence of known SNPs in variant protein T59832_P9 (SEQ ID NO:145) sequence provides support for the deduced sequence of this variant protein according to the present invention). TABLE-US-00263 TABLE 11 Nucleic acid SNPs SNP position on Alternative Previously nucleotide sequence nucleic acid known SNP? 61 C→T Yes 148 G→T Yes 651 C→A No 656 C→No 656 C→G No 686 A→G Yes 751 A→G Yes 760 C→No 760 C→A No 777 C→T Yes 792 T→G No 812 G→A No 212→A No 812 G→C No 848 C→No 848 C→T No 877 C→No 892 G→A No 907 G→T Yes 914 A→No 936→T No 937 C→T No 956 C→No 241 G→T No 962 A→G Yes 974 G→A Yes 1017 A→C Yes 1042 A→C Yes 1050 T→C Yes 244 A→G Yes 375 G→A Yes 377 G→A No 439 G→C Yes 585 T→No 586 T→G Yes Variant protein T59832_P12 (SEQ ID NO:146) according to the present invention has an amino acid sequence as given at the end of the-application; it is encoded by transcript(s) T59832_T15 (SEQ ID NO:104). An alignment is given to the known protein (Gamma-interferon inducible lysosomal thiol reductase precursor (SEQ ID NO:142)) at the end of the application. One or more alignments to one or more previously published protein sequences are given at the end of the application. A brief description of the relationship of the variant protein according to the present invention to each such aligned protein is as follows:

Comparison report between T59832_P12 (SEQ ID NO:146) and GILT_HUMAN (SEQ ID NO:142):

1. An isolated chimeric polypeptide encoding for T59832_P12 (SEQ ID NO:146), comprising a first amino acid sequence being at least 90% homologous to MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVE corresponding to amino acids 12-141 of GILT_HUMAN (SEQ ID NO:142), which also corresponds to amino acids 1-130 of T59832_P12 (SEQ ID NO:146), and a second amino acid sequence being at least 90% homologous to CLQLYAPGLSPDTIMECAMGDRGMQLMHANAQRTDALQPPHEYVPWVTVNGKPLEDQTQLLTLVCQLYQGKKPDVCPSSTSSLRSVCFK corresponding to amino acids 173-261 of GILT_HUMAN (SEQ ID NO:142), which also corresponds to amino acids 131-219 of T59832_P12 (SEQ ID NO:146), wherein said first and second amino acid sequences are contiguous and in a sequential order.

2. An isolated chimeric polypeptide encoding for an edge portion of T59832_P12 (SEQ ID NO:146), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EC, having a structure as follows: a sequence starting from any of amino acid numbers 130-x to 130; and ending at any of amino acid numbers 131+((n-2)-x), in which x varies from 0 to n-2.

Comparison report between T59832_P12 (SEQ ID NO:146) and BAC85622 (SEQ ID NO:849):

1. An isolated chimeric polypeptide encoding for T59832_P12 (SEQ ID NO:146), comprising a first amino acid sequence being at least 70%, optionally at least 80%, preferably at least 85%, more preferably at least 90% and most preferably at least 95% homologous to a polypeptide having the sequence MTLSPLLLFLPPLLLLLDVPTAAVQASPLQALDFFGNGPPVNYKTGNLYLRGPLKKSNA PLVNVTLYYEALCGGCRAFLIRELFPTWLLV (SEQ ID NO:1012) corresponding to amino acids 1-90 of T59832_P12 (SEQ ID NO:146), second amino acid sequence being at least 90% homologous to MEILNVTLVPYGNAQEQNVSGRWEFKCQHGEEECKFNKVE corresponding to amino acids 1-40 of BAC85622 (SEQ ID NO:849), which also corresponds to amino acids 91-130 of T59832_P12 (SEQ ID NO:146), third amino acid sequence being at least 90% homologous to CLQLYAPGLSPDTIMECAMGDRGMQLMHANAQRTDALQPPHEYVPWVTVNG corresponding to amino acids 72-122 of BAC85622 (SEQ ID NO:849), which also corresponds to amino acids 131-181 of T59832_P12 (SEQ ID NO:146), and a fourth amino acid sequence being at least 70%, optionally at least 80%, preferably at least 85%, more preferably at least 90% and most preferably at least 95% homologous to a polypeptide having the sequence KPLEDQTQLLTLVCQLYQGKKPDVCPSSTSSLRSVCFK (SEQ ID NO:1016) corresponding to amino acids 182-219 of T59832_P12 (SEQ ID NO:146), wherein said first, second, third and fourth amino acid sequences are contiguous and in a sequential order.

2. An isolated polypeptide encoding for a head of T59832_P12 (SEQ ID NO:146), comprising a polypeptide being at least 70%, optionally at least about 80%, preferably at least about 85%, more preferably at least about 90% and most preferably at least about 95% homologous to the sequence TABLE-US-00264 MTLSPLLLFLPPLLLLLDVPTMVQASPLQALDFFGNGPPVNYKTGN-LYLRGPLKKSNA (SEQ ID NO: 1012) PLVNVTLYYEAL-CGGCRAFLIRELFPTWLLV of T59832_P12. (SEQ ID NO: 146)

3. An isolated chimeric polypeptide encoding for an edge portion of T59832_P12 (SEQ ID NO:146), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EC, having a structure as follows: a sequence starting from any of amino acid numbers 130-x to 130; and ending at any of amino acid numbers 131+((n-2)-x), in which x varies from 0 to n-2.

4. An isolated polypeptide encoding for a tail of T59832_P12 (SEQ ID NO:146), comprising a polypeptide being at least 70%, optionally at least about 80%, preferably at least about 85%, more preferably at least about 90% and most preferably at least about 95% homologous to the sequence KPLEDQTQLLTLVCQLYQGKKPD-VCPSSTSSLRSVCFK (SEQ ID NO:1016) in T59832_P12 (SEQ ID NO:146).

Comparison report between T59832_P12 (SEQ ID NO:146) and Q8WU77 (SEQ ID NO:850):

1. An isolated chimeric polypeptide encoding for T59832_P12 (SEQ ID NO:146), comprising a first amino acid sequence being at least 90% homologous to MTL-SPLLLFLPPLLLLLDVPTAAVQAS-PLQALDFFGNGPPVNYKTGNLYLRGPLKKSNA PLVNVTLYYEALCGGCRAFLIRELF-PTWLLVMEILNVTLVPYGNAQEQNVSGRWEFKC QHGEEECKFNKVE corresponding to amino acids 1-130 of Q8WU77 (SEQ ID NO:850), which also corresponds to amino acids 1-130 of T59832_P12 (SEQ ID NO:146), and a second amino acid sequence being at least 90% homologous to CLQLYAPGLSPDTIMECAMGDRGMQLM-HANAQRTDALQPPHEYVPWVTVNGKPLED QTQLLTLVCQLYQGKKPDVCPSSTSSLRSVCFK corresponding to amino acids 162-250 of Q8WU77 (SEQ ID NO:850), which also corresponds to amino acids 131-219 of T59832_P12 (SEQ ID NO:146), wherein said first and second amino acid sequences are contiguous and in a sequential order.

2. An isolated chimeric polypeptide encoding for an edge portion of T59832_P12 (SEQ ID NO:146), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EC, having a structure as follows: a sequence starting from any of amino acid numbers 130-x to 130; and ending at any of amino acid numbers 131+((n−2)-x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T59832_P12 (SEQ ID NO:146) also has the following non-silent SNPs (Single Nucleotide Polymorphisms) as listed in Table 12, (given according to their position(s) on the amino acid sequence, with the alternative amino acid(s) listed; the last column indicates whether the SNP is known or not; the presence of known SNPs in variant protein T59832_P12 (SEQ ID NO:146) sequence provides support for the deduced sequence of this variant protein according to the present invention). TABLE-US-00265 TABLE 12 Amino acid mutations SNP position(s) on Alternative Previously amino acid sequence amino acid(s) known SNP? 137 P→Q No 139 L→No 76 R→Q Yes 77 A→T No 139 L→V No 149 M→V Yes 183 P→No 183 P→T No 200 G→A No 200 G→D No 212 S→No 212 S→F No Variant protein T59832_P12 (SEQ ID NO:146) is encoded by the following transcript(s): T59832_T15 (SEQ ID NO:104), for which the sequence(s) is/are given at the end of the application. The coding portion of transcript T59832_T15 (SEQ ID NO: 104) is shown in bold; this coding portion starts at position 149 and ends at position 805. The transcript also has the following SNPs as listed in Table 13 (given according to their position on the nucleotide sequence, with the alternative nucleic acid listed; the last column indicates whether the SNP is known or not; the presence of known SNPs in variant protein T59832_P12 (SEQ ID NO:146) sequence provides support for the deduced sequence of this variant protein according to the present invention). TABLE-US-00266 TABLE 13 Nucleic acid SNPs SNP position on Alternative Previously nucleotide sequence nucleic acid known SNP? 61 C→T Yes 148 G→T Yes 563 C→G No 593 A→G Yes 658 A→G Yes 695 C→No 695 C→A No 712 C→T Yes 727 T→G No 747 G→A No 747 G→C No 783 C→No 212→A No 783 C→T No 812 C→No 827 G→A No 842 G→T Yes 849 A→No 871→T No 872 C→T No 891 C→No 897 A→G Yes 909 G→A Yes 241 G→T No 952 A→C Yes 977 A→C Yes 985 T→C Yes 244 A→G Yes 375 G→A Yes 377 G→A No 439 G→C Yes 558 C→A No 563 C→No Variant protein T59832_P18 (SEQ ID NO:147) according to the present invention has an amino acid sequence as given at the end of the application; it is encoded by transcript(s) T59832_T22 (SEQ ID NO:105). An alignment is given to the known protein (Gamma-interferon inducible lysosomal thiol reductase precursor (SEQ ID NO:142)) at the end of the application. One or more alignments to one or more previously published protein sequences are given at the end of the application. A brief description of the relationship of the variant protein according to the present invention to each such aligned protein is as follows:

Comparison report between T59832_P18 (SEQ ID NO:147) and GILT_HUMAN (SEQ ID NO: 142):

1. An isolated chimeric polypeptide encoding for T59832_P18 (SEQ ID NO:147), comprising a first amino acid sequence being at least 90% homologous to MTL-SPLLLFLPPLLLLLDVPTAAVQAS-PLQALDFFGNGPPVNYK corresponding to amino acids 12-55 of GILT_HUMAN (SEQ ID NO:142), which also corresponds to amino acids 1-44 of T59832_P18 (SEQ ID NO:147), and a second amino acid sequence being at least 90% homologous to CLQLYAPGLSPDTIMECAMGDRG-MQLMHANAQRTDALQPPHEYVPWVTVNGKPLED QTQLLTLVCQLYQGKKPDVCPSSTSSLRSVCFK corresponding to amino acids 173-261 of GILT_HUMAN (SEQ ID NO:142), which also corresponds to amino acids 45-133 of T59832_P18 (SEQ ID NO:147), wherein said first and second amino acid sequences are contiguous and in a sequential order.

2. An isolated chimeric polypeptide encoding for an edge portion of T59832_P18 (SEQ ID NO:147), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KC, having a structure as follows: a sequence starting from any of amino acid numbers 44-x to 44; and ending at any of amino acid numbers 45+((n−2)-x), in which x varies from 0 to n−2.

Comparison report between T59832_P18 (SEQ ID NO:147) and Q8WU77 (SEQ ID NO:850):

1. An isolated chimeric polypeptide encoding for T59832_P18 (SEQ ID NO:147), comprising a first amino acid sequence being at least 90% homologous to MTL-SPLLLFLPPLLLLLDVPTAAVQAS-PLQALDFFGNGPPVNYK corresponding to amino acids 1-44 of Q8WU77 (SEQ ID NO:850), which also corresponds to amino acids 1-44 of T59832-P18 (SEQ ID NO:147), and a second amino acid sequence being at least 90% homologous to CLQLYAPGLSPDTIMECAMGDRGMQLM- HANAQRTDALQPPHEYVPWVTVNGKPLED QTQLLTLVCQLYQGKKPDVCPSSTSSLRSVCFK corresponding to amino acids 162-250 of Q8WU77 (SEQ ID NO:850), which also corresponds to amino acids 45-133 of T59832_P18 (SEQ ID NO:147), wherein said first and second amino acid sequences are contiguous and in a sequential order.

2. An isolated chimeric polypeptide encoding for an edge portion of T59832_P18 (SEQ ID NO:147), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KC, having a structure as follows: a sequence starting from any of amino acid numbers 44-x to 44; and ending at any of amino acid numbers 45+((n−2)-x), in which x varies from 0 to n−2.

Comparison report between T59832_P18 (SEQ ID NO:147) and Q8NE14 (SEQ ID NO:851):

1. An isolated chimeric polypeptide encoding for T59832_P18 (SEQ ID NO:147), comprising a first amino acid sequence being at least 90% homologous to MTLSPLLLFLPPLLLLLDVPTAAVQAS-PLQALDFFGNGPPVNYK corresponding to amino acids 1-44 of Q8NE14 (SEQ ID NO:851), which also corresponds to amino acids 1-44 of T59832_P18 (SEQ ID NO:147), and a second amino acid sequence being at least 90% homologous to CLQLYAPGLSPDTIMECAMGDRGMQLM-HANAQRTDALQPPHEYVPWVTVNGKPLED QTQLLTLVCQLYQGKKPDVCPSSTSSLRSVCFK corresponding to amino acids 162-250 of Q8NE14 (SEQ ID NO:851), which also corresponds to amino acids 45-133 of T59832_P18 (SEQ ID NO:147), wherein said first and second amino acid sequences are contiguous and in a sequential order.

2. An isolated chimeric polypeptide encoding for an edge portion of T59832_P18 (SEQ ID NO:147), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KC, having a structure as follows: a sequence starting from any of amino acid numbers 44-x to 44; and ending at any of amino acid numbers 45+((n−2)-x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T59832_P18 (SEQ ID NO:147) also has the following non-silent SNPs (Single Nucleotide Polymorphisms) as listed in Table 14, (given according to their position(s) on the amino acid sequence, with the alternative amino acid(s) listed; the last column indicates whether the SNP is known or not; the presence of known SNPs in variant protein T59832_P18 (SEQ ID NO:147) sequence provides support for the deduced sequence of this variant protein according to the present invention). TABLE-US-00267 TABLE 14 Amino acid mutations SNP position(s) on Alternative Previously amino acid sequence amino acid(s) known SNP? 114 G→A No 114 G→D No 126 S→No 126 S→F No 51 P→Q No 53 L→No 53 L→V No63 M→V Yes 97 P→No 97 P→T No Variant protein T59832_P18 (SEQ ID NO:147) is encoded by the following transcript(s): T59832_T22 (SEQ ID NO:105), for which the sequence(s) is/are given at the end of the application. The coding portion of transcript T59832_T22 (SEQ ID NO:105) is shown in bold; this coding portion starts at position 149 and ends at position 547. The transcript also has the following SNPs as listed in Table 15 (given according to their position on the nucleotide sequence, with the alternative nucleic acid listed; the last column indicates whether the SNP is known or not; the presence of known SNPs in variant protein T59832_P18 (SEQ ID NO:147) sequence provides support for the deduced sequence of this variant protein according to the present invention). TABLE-US-00268 TABLE 15 Nucleic acid SNPs SNP position on Alternative Previously nucleotide sequence nucleic acid known SNP? 61 C→T Yes 148 G→T Yes 437 C→No 437 C→A No 454 C→T Yes 469 T→G No 489 G→A No 489 G→C No 525 C→No 525 C→T No 554 C→No 569 G→A No 212→A No 584 G→T Yes 591 A→No 613 T No 614 C→T No 633 C→No 639 A→G Yes 651 G→A Yes 694 A→C Yes 719 A→C Yes 727 T→C Yes 241 G→T No 244 A→G Yes 300 C→A No 305 C→No 305 C→G No 335 A→G Yes 400 A→G Yes As noted above, cluster T59832 features 33 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T59832_node.sub.--1 (SEQ ID NO:109) according to the present invention is supported by 62 libraries. The number of libraries was determined as previously described. This segment can be found in the following transcript(s): T59832_T11 (SEQ ID NO:103), T59832_T15 (SEQ ID NO:104), T59832_T22 (SEQ ID NO:105), T59832_T6 (SEQ ID NO:107) and T59832_T8 (SEQ ID NO:108). Table 16 below describes the starting and ending position of this segment on each transcript. TABLE-US-00269 TABLE 16 Segment location on transcripts Segment Segment Transcript name starting position ending position T59832_T11 (SEQ ID 1 123 NO: 103) T59832_T15 (SEQ ID 1 123 NO: 104) T59832_T22 (SEQ ID 1 123 NO: 105) T59832_T6 (SEQ ID NO: 107) 1 123 T59832_T8 (SEQ ID NO: 108) 1 123

Segment cluster T59832_node.sub.--22 (SEQ ID NO:110) according to the present invention is supported by 4 libraries. The number of libraries was determined as previously described. This segment can be found in the following transcript(s): T59832_T28 (SEQ ID NO:106). Table 17 below describes the starting and ending position of this segment on each transcript. TABLE-US-00270 TABLE 17 Segment location on transcripts Segment Segment Transcript name starting position ending position T59832_T28 (SEQ ID 1 523 NO: 106)

Segment cluster T59832_node.sub.--23 (SEQ ID NO:111) according to the present invention is supported by 1 libraries. The number of libraries was determined as previously described. This segment can be found in the following transcript(s): T59832_T28 (SEQ ID NO:106). Table 18 below describes the starting and ending position of this segment on each transcript. TABLE-US-00271 TABLE 18 Segment location on transcripts Segment Segment Transcript name starting position ending position T59832_T28 (SEQ ID 524 652 NO: 106)

Segment cluster T59832_node.sub.--24 (SEQ ID NO:112) according to the present invention is supported by 4 libraries. The number of libraries was determined as previously described. This segment can be found in the following transcript(s): T59832_T28 (SEQ ID NO:106). Table 19 below describes the starting and ending position of this segment on each transcript. TABLE-US-00272 TABLE 19 Segment location on transcripts Segment Segment Transcript name starting position ending position T59832_T28 (SEQ ID 653 901 NO: 106)

Segment cluster T59832_node.sub.--29 (SEQ ID NO:113) according to the present invention is supported by 12 libraries. The number of libraries was determined as previously described. This segment can be found in the following transcript(s): T59832_T28 (SEQ ID NO:106) and T59832_T8 (SEQ ID NO:108). Table 20 below describes the starting and ending position of this segment on each transcript. TABLE-US-00273 TABLE 20 Segment location on transcripts Segment Segment Transcript name starting position ending position T59832_T28 (SEQ ID 1055 1472 NO: 106) T59832_T8 (SEQ ID NO: 108) 785 1202

Segment cluster T59832_node.sub.--39 (SEQ ID NO:114) according to the present invention is supported by 195 libraries. The number of libraries was determined as previously described. This segment can be found in the following transcript(s): T59832_T11 (SEQ ID NO:103), T59832_T15 (SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 21 below describes the starting and ending position of this segment on each transcript. TABLE-US-00274 TABLE 21 Segment location on transcripts Segment Segment Transcript name starting position ending position T59832_T11 (SEQ ID 1031 1084 NO: 103) T59832_T15 (SEQ ID 966 1019 NO: 104) T59832_T22 (SEQ ID 708 761 NO: 105) T59832_T28 (SEQ ID 1747 1800 NO: 106) T59832_T6 (SEQ ID NO: 107) 2125 2178 T59832_T8 (SEQ ID NO: 108) 1477 1530

Segment cluster T59832_node.sub.--7 (SEQ ID NO:115) according to the present invention is supported by 8 libraries. The number of libraries was determined as previously described. This segment can be found in the following transcript(s): T59832_T6 (SEQ ID NO:107). Table 22 below describes the starting and ending position of this segment on each transcript. TABLE-US-00275 TABLE 22 Segment location on transcripts Segment Segment Transcript name starting position ending position T59832_T6 (SEQ ID NO: 107) 281 1346

According to an optional embodiment of the present invention, short segments related to the above cluster are also provided. These segments are up to about 120 bp in length, and so are included in a separate description.

Segment cluster T59832_node.sub.--10 (SEQ ID NO:116) according to the present invention is supported by 332 libraries. The number of libraries was determined as previously described. This segment can be found in the following transcript(s): T59832_T11 (SEQ ID NO:103), T59832_T15 (SEQ ID NO:104), T59832_T6 (SEQ ID NO:107) and T59832_T8 (SEQ ID NO:108). Table 23 below describes the starting and ending position of this segment on each transcript. TABLE-US-00276 TABLE 23 Segment location on transcripts Segment Segment Transcript name starting position ending position T59832_T11 (SEQ ID 338 382 NO: 103) T59832_T15 (SEQ ID 338 382 NO: 104) T59832_T6 (SEQ ID NO: 107) 1404 1448 T59832_T8 (SEQ ID NO: 108) 338 382

Segment cluster T59832_node.sub.--11 (SEQ ID NO:117) according to the present invention is supported by 306 libraries. The number of libraries was determined as previously described. This segment can be found in the following transcript(s): T59832_T11 (SEQ ID NO:103), T59832_T15 (SEQ ID NO:104), T59832_T6 (SEQ ID NO:107) and T59832_T8 (SEQ ID NO:108). Table 24 below describes the starting and ending position of this segment on each transcript. TABLE-US-00277 TABLE 24 Segment location on transcripts Segment Segment Transcript name starting position ending position T59832_T11 (SEQ ID 383 417 NO: 103) T59832_T15 (SEQ ID 383 417 NO: 104) T59832_T6 (SEQ ID NO: 107) 1449 1483 T59832_T8 (SEQ ID NO: 108) 383 417

Segment cluster T59832_node.sub.--12 (SEQ ID NO:118) according to the present invention is supported by 280 libraries. The number of libraries was determined as previously described. This segment can be found in the following transcript(s): T59832_T11 (SEQ ID NO:103), T59832_T15 (SEQ ID NO:104), T59832_T6 (SEQ ID NO:107) and T59832_T8 (SEQ ID NO:108). Table 25 below describes the starting and ending position of this segment on each transcript. TABLE-US-00278 TABLE 25 Segment location on transcripts Segment Segment Transcript name starting position ending position T59832_T11 (SEQ ID 418 463 NO: 103) T59832_T15 (SEQ ID 418 463 NO: 104) T59832_T6 (SEQ ID NO: 107) 1484 1529 T59832_T8 (SEQ ID NO: 108) 418 463

Segment cluster T59832_node.sub.--14 (SEQ ID NO:119) according to the present invention is supported by 280 libraries. The number of libraries was determined as previously described. This segment can be found in the following transcript(s): T59832_T11 (SEQ ID NO:103), T59832_T15 (SEQ ID NO:104), T59832_T6 (SEQ ID NO:107) and T59832_T8 (SEQ ID NO:108). Table 26 below describes the starting and ending position of this segment on each transcript. TABLE-US-00279 TABLE 26 Segment location on transcripts Segment Segment Transcript name starting position ending position T59832_T11 (SEQ ID 464 502 NO: 103) T59832_T15 (SEQ ID 464 502 NO: 104) T59832_T6 (SEQ ID NO: 107) 1530 1568 T59832_T8 (SEQ ID NO: 108) 464 502

Segment cluster T59832_node.sub.--16 (SEQ ID NO:120) according to the present invention is supported by 287 libraries. The number of libraries was determined as previously described. This segment can be found in the following transcript(s): T59832_T11 (SEQ ID NO:103), T59832_T15 (SEQ ID NO:104), T59832_T6 (SEQ ID NO:107) and T59832_T8 (SEQ ID NO:108). Table 27 below describes the starting and ending position of this segment on each transcript. TABLE-US-00280 TABLE 27 Segment location on transcripts Segment Segment Transcript name starting position ending position T59832_T11 (SEQ ID 503 538 NO: 103) T59832_T15 (SEQ ID 503 538 NO: 104) T59832_T6 (SEQ ID NO: 107) 1569 1604 T59832_T8 (SEQ ID NO: 108) 503 538

Segment cluster T59832_node.sub.--19 (SEQ ID NO:121) according to the present invention is supported by 300 libraries. The number of libraries was determined as previously described. This segment can be found in the following transcript(s): T59832_T11 (SEQ ID NO:103), T59832_T6 (SEQ ID NO:107) and T59832_T8 (SEQ ID NO:108). Table 28 below describes the starting and ending position of this segment on each transcript. TABLE-US-00281 TABLE 28 Segment location on transcripts Segment Segment Transcript name starting position ending position T59832_T11 (SEQ ID 539 577 NO: 103) T59832_T6 (SEQ ID NO: 107) 1605 1643 T59832_T8 (SEQ ID NO: 108) 539 577

Segment cluster T59832_node.sub.--2 (SEQ ID NO:122) according to the present invention is supported by 258 libraries. The number of libraries was determined as previously described. This segment can be found in the following transcript(s): T59832_T11 (SEQ ID NO:103), T59832_T15 (SEQ ID NO:104), T59832_T22 (SEQ ID NO:105), T59832_T6 (SEQ ID NO:107) and T59832_T8 (SEQ ID NO:108). Table 29 below describes the starting and ending position of this segment on each transcript. TABLE-US-00282 TABLE 29 Segment location on transcripts Segment Segment Transcript name starting position ending position T59832_T11 (SEQ ID 124 154 NO: 103) T59832_T15 (SEQ ID 124 154 NO: 104) T59832_T22 (SEQ ID 124 154 NO: 105) T59832_T6 (SEQ ID NO: 107) 124 154 T59832_T8 (SEQ ID NO: 108) 124 154

Segment cluster T59832_node.sub.--20 (SEQ ID NO:123) according to the present invention is supported by 318 libraries. The number of libraries was determined as previously described. This segment can be found in the following transcript(s): T59832_T11 (SEQ ID NO:103), T59832_T6 (SEQ ID NO:107) and T59832_T8 (SEQ ID NO:108). Table 30 below describes the starting and ending position of this segment on each transcript. TABLE-US-00283 TABLE 30 Segment location on transcripts Segment Segment Transcript name starting position ending position T59832_T11 (SEQ ID 578 631 NO: 103) T59832_T6 (SEQ ID NO: 107) 1644 1697 T59832_T8 (SEQ ID NO: 108) 578 631

Segment cluster T59832_node.sub.--25 (SEQ ID NO:124) according to the present invention can be found in the following transcript(s): T59832_T11 (SEQ ID NO:103), T59832_T15 (SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 31 below describes the starting and ending position of this segment on each transcript. TABLE-US-00284 TABLE 31 Segment location on transcripts Segment Segment Transcript name starting position ending position T59832_T11 (SEQ ID 632 653 NO: 103) T59832_T15 (SEQ ID 539 560 NO: 104) T59832_T22 (SEQ ID 281 302 NO: 105) T59832_T28 (SEQ ID 902 923 NO: 106) T59832_T6 (SEQ ID NO: 107) 1698 1719 T59832_T8 (SEQ ID NO: 108) 632 653

Segment cluster T59832_node.sub.--26 (SEQ ID NO:125) according to the present invention is supported by 342 libraries. The number of libraries was determined as previously described. This segment can be found in the following transcript(s): T59832_T11 (SEQ ID NO:103), T59832_T15 (SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 32 below describes the starting and ending position of this segment on each transcript. TABLE-US-00285 TABLE 32 Segment location on transcripts Segment Segment Transcript name starting position ending position T59832_T11 (SEQ ID 654 717 NO: 103) T59832_T15 (SEQ ID 561 624 NO: 104) T59832_T22 (SEQ ID 303 366 NO: 105) T59832_T28 (SEQ ID 924 987 NO: 106) T59832_T6 (SEQ ID NO: 107) 1720 1783 T59832_T8 (SEQ ID NO: 108) 654 717

Segment cluster T59832_node.sub.--27 (SEQ ID NO:126) according to the present invention is supported by 314 libraries. The number of libraries was determined as previously described. This segment can be found in the following transcript(s): T59832_T11 (SEQ ID NO:103), T59832_T15 (SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 33 below describes the starting and ending position of this segment on each transcript. TABLE-US-00286 TABLE 33 Segment location on transcripts Segment Segment Transcript name starting position ending position T59832_T11 (SEQ ID 718 756 NO: 103) T59832_T15 (SEQ ID 625 663 NO: 104) T59832_T22 (SEQ ID 367 405 NO: 105) T59832_T28 (SEQ ID 988 1026 NO: 106) T59832_T6 (SEQ ID NO: 107) 1784 1822 T59832_T8 (SEQ ID NO: 108) 718 756

Segment cluster T59832_node.sub.--28 (SEQ ID NO:127) according to the present invention is supported by 284 libraries. The number of libraries was determined as previously described. This segment can be found in the following transcript(s): T59832_T15 (SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 34 below describes the starting and ending position of this segment on each transcript. TABLE-US-00287 TABLE 34 Segment location on transcripts Segment Segment Transcript name starting position ending position T59832_T15 (SEQ ID 664 691 NO: 104) T59832_T22 (SEQ ID 406 433 NO: 105) T59832_T28 (SEQ ID 1027 1054 NO: 106) T59832_T6 (SEQ ID NO: 107) 1823 1850 T59832_T8 (SEQ ID NO: 108) 757 784

Segment cluster T59832_node.sub.--3 (SEQ ID NO:128) according to the present invention can be found in the following transcript(s): T59832_T11 (SEQ ID NO:103), T59832_T15 (SEQ ID NO:104), T59832_T22 (SEQ ID NO:105), T59832_T6 (SEQ ID NO:107) and T59832_T8 (SEQ ID NO:108). Table 35 below describes the starting and ending position of this segment on each transcript. TABLE-US-00288 TABLE 35 Segment location on transcripts Segment Segment Transcript name starting position ending position T59832_T11 (SEQ ID 155 172 NO: 103) T59832_T15 (SEQ ID 155 172 NO: 104) T59832_T22 (SEQ ID 155 172 NO: 105) T59832_T6 (SEQ ID NO: 107) 155 172 T59832_T8 (SEQ ID NO: 108) 155 172

Segment cluster T59832_node.sub.--30 (SEQ ID NO:129) according to the present invention can be found in the following transcript(s): T59832_T11 (SEQ ID NO:103), T59832_T15 (SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 36 below describes the starting and ending position of this segment on each transcript. TABLE-US-00289 TABLE 36 Segment location on transcripts Segment Segment Transcript name starting position ending position T59832_T11 (SEQ ID 757 760 NO: 103) T59832_T15 (SEQ ID 692 695 NO: 104) T59832_T22 (SEQ ID 434 437 NO: 105) T59832_T28 (SEQ ID 1473 1476 NO: 106) T59832_T6 (SEQ ID NO: 107) 1851 1854 T59832_T8 (SEQ ID NO: 108) 1203 1206

Segment cluster T59832_node.sub.--31 (SEQ ID NO:130) according to the present invention can be found in the following transcript(s): T59832_T11 (SEQ ID NO:103), T59832_T15 (SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 37 below describes the starting and ending position of this segment on each transcript. TABLE-US-00290 TABLE 37 Segment location on transcripts Segment Segment Transcript name starting position ending position T59832_T11 (SEQ ID 761 780 NO: 103) T59832_T15 (SEQ ID 696 715 NO: 104) T59832_T22 (SEQ ID 438 457 NO: 105) T59832_T28 (SEQ ID 1477 1496 NO: 106) T59832_T6 (SEQ ID NO: 107) 1855 1874 T59832_T8 (SEQ ID NO: 108) 1207 1226

Segment cluster T59832_node.sub.--32 (SEQ ID NO:131) according to the present invention is supported by 287 libraries. The number of libraries was determined as previously described. This segment can be found in the following transcript(s): T59832_T11 (SEQ ID NO:103), T59832_T15

(SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 38 below describes the starting and ending position of this segment on each transcript.

TABLE-US-00291 TABLE 38 Segment location on transcripts Segment Segment Transcript name starting position ending position T59832_T11 (SEQ ID 781 810 NO: 103) T59832_T15 (SEQ ID 716 745 NO: 104) T59832_T22 (SEQ ID 458 487 NO: 105) T59832_T28 (SEQ ID 1497 1526 NO: 106) T59832_T6 (SEQ ID NO: 107) 1875 1904 T59832_T8 (SEQ ID NO: 108) 1227 1256

Segment cluster T59832_node.sub.--34 (SEQ ID NO: 132) according to the present invention can be found in the following transcript(s): T59832_T11 (SEQ ID NO:103), T59832_T15 (SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 39 below describes the starting and ending position of this segment on each transcript.

TABLE-US-00292 TABLE 39 Segment location on transcripts Segment Segment Transcript name starting position ending position T59832_T11 (SEQ ID 811 832 NO: 103) T59832_T15 (SEQ ID 746 767 NO: 104) T59832_T22 (SEQ ID 488 509 NO: 105) T59832_T28 (SEQ ID 1527 1548 NO: 106) T59832_T6 (SEQ ID NO: 107) 1905 1926 T59832_T8 (SEQ ID NO: 108) 1257 1278

Segment cluster T59832_node.sub.--35 (SEQ ID NO:133) according to the present invention can be found in the following transcript(s): T59832_T11 (SEQ ID NO:103), T59832_T15 (SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 40 below describes the starting and ending position of this segment on each transcript.

TABLE-US-00293 TABLE 40 Segment location on transcripts Segment Segment Transcript name starting position ending position T59832_T11 (SEQ ID 833 836 NO: 103) T59832_T15 (SEQ ID 768 771 NO: 104) T59832_T22 (SEQ ID 510 513 NO: 105) T59832_T28 (SEQ ID 1549 1552 NO: 106) T59832_T6 (SEQ ID NO: 107) 1927 1930 T59832_T8 (SEQ ID NO: 108) 1279 1282

Segment cluster T59832_node.sub.--36 (SEQ ID NO:134) according to the present invention can be found in the following transcript(s): T59832_T11 (SEQ ID NO:103), T59832_T15 (SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 41 below describes the starting and ending position of this segment on each transcript.

TABLE-US-00294 TABLE 41 Segment location on transcripts Segment Segment Transcript name starting position ending position T59832_T11 (SEQ ID 837 845 NO: 103) T59832_T15 (SEQ ID 772 780 NO: 104) T59832_T22 (SEQ ID 514 522 NO: 105) T59832_T28 (SEQ ID 1553 1561 NO: 106) T59832_T6 (SEQ ID NO: 107) 1931 1939 T59832_T8 (SEQ ID NO: 108) 1283 1291

Segment cluster T59832_node.sub.--37 (SEQ ID NO:135) according to the present invention is supported by 300 libraries. The number of libraries was determined as previously described. This segment can be found in the following transcript(s): T59832_T11 (SEQ ID NO:103), T59832_T15 (SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 42 below describes the starting and ending position of this segment on each transcript.

TABLE-US-00295 TABLE 42 Segment location on transcripts Segment Segment Transcript name starting position ending position T59832_T11 (SEQ ID 846 945 NO: 103) T59832_T15 (SEQ ID 781 880 NO: 104) T59832_T22 (SEQ ID 523 622 NO: 105) T59832_T28 (SEQ ID 1562 1661 NO: 106) T59832_T6 (SEQ ID NO: 107) 1940 2039 T59832_T8 (SEQ ID NO: 108) 1292 1391

Segment cluster T59832_node.sub.--38 (SEQ ID NO:136) according to the present invention is supported by 247 libraries. The number of libraries was determined as previously described. This segment can be found in the following transcript(s): T59832_T11 (SEQ ID NO:103), T59832_T15 (SEQ ID NO:104), T59832_T22 (SEQ ID NO:105), T59832_T28 (SEQ ID NO:106), T59832_T6 (SEQ ID NO:107) and T59832_T8 (SEQ ID NO:108). Table 43 below describes the starting and ending position of this segment on each transcript.

TABLE-US-00296 TABLE 43 Segment location on transcripts Segment Segment Transcript name starting position ending position T59832_T11 (SEQ ID 946 1030 NO: 103) T59832_T15 (SEQ ID 881 965 NO: 104) T59832_T22 (SEQ ID 623 707 NO: 105) T59832_T28 (SEQ ID 1662 1746 NO: 106) T59832_T6 (SEQ ID NO: 107) 2040 2124 T59832_T8 (SEQ ID NO: 108) 1392 1476

Segment cluster T59832_node.sub.--4 (SEQ ID NO:137) according to the present invention is supported by 296 libraries. The number of libraries was determined as previously described. This segment can be found in the following transcript(s): T59832_T11 (SEQ ID NO:103), T59832_T15 (SEQ ID NO:104), T59832_T22 (SEQ ID NO:105), T59832_T6 (SEQ ID NO:107) and T59832_T8 (SEQ ID NO:108). Table 44 below describes the starting and ending position of this segment on each transcript.

TABLE-US-00297 TABLE 44 Segment location on transcripts Segment Segment Transcript name starting position ending position T59832_T11 (SEQ ID 173 223 NO: 103) T59832_T15 (SEQ ID 173 223 NO: 104) T59832_T22 (SEQ ID 173 223 NO: 105) T59832_T6 (SEQ ID NO: 107) 173 223 T59832_T8 (SEQ ID NO: 108) 173 223

Segment cluster T59832_node.sub.--5 (SEQ ID NO:138) according to the present invention is supported by 305 libraries. The number of libraries was determined as previously described. This segment can be found in the following transcript(s): T59832_T11 (SEQ ID NO:103), T59832_T15 (SEQ ID NO:104), T59832_T22 (SEQ ID NO:105), T59832_T6 (SEQ ID NO:107) and T59832_T8 (SEQ ID NO:108). Table 45 below describes the starting and ending position of this segment on each transcript.

TABLE-US-00298 TABLE 45 Segment location on transcripts Segment Segment Transcript name starting position ending position T59832_T11 (SEQ ID 224 259 NO: 103) T59832_T15 (SEQ ID 224 259 NO: 104) T59832_T22 (SEQ ID 224 259 NO: 105) T59832_T6 (SEQ ID NO: 107) 224 259 T59832_T8 (SEQ ID NO: 108) 224 259

Segment cluster T59832 node.sub.--6 (SEQ ID NO:139) according to the present invention can be found in the following transcript(s): T59832_T11 (SEQ ID NO:103), T59832_T15 (SEQ ID NO:104), T59832_T22 (SEQ ID NO:105), T59832_T6 (SEQ ID NO:107) and T59832_T8 (SEQ ID NO:108). Table 46 below describes the starting and ending position of this segment on each transcript.

TABLE-US-00299 TABLE 46 Segment location on transcripts Segment Segment Transcript name starting position ending position T59832_T11 (SEQ ID 260 280 NO: 103) T59832_T15 (SEQ ID 260 280 NO: 104) T59832_T22 (SEQ ID 260 280 NO: 105) T59832_T6 (SEQ ID NO: 107) 260 280 T59832_T8 (SEQ ID NO: 108) 260 280

Segment cluster T59832_node.sub.--8 (SEQ ID NO:140) according to the present invention can be found in the following transcript(s): T59832_T11 (SEQ ID NO:103), T59832_T15 (SEQ ID NO:104), T59832_T6 (SEQ ID NO:107) and T59832_T8 (SEQ ID NO:108). Table 47 below describes the starting and ending position of this segment on each transcript. TABLE-US-00300 TABLE 47 Segment location on transcripts Segment Segment Transcript name starting position ending position T59832_T11 (SEQ ID 281 301 NO: 103) T59832_T15 (SEQ ID 281 301 NO: 104) T59832_T6 (SEQ ID NO: 107) 1347 1367 T59832_T8 (SEQ ID NO: 108) 281 301

Segment cluster T59832_node.sub.--9 (SEQ ID NO:141) according to the present invention is supported by 330 libraries. The number of libraries was determined as previously described. This segment can be found in the following transcript(s): T59832_T11 (SEQ ID NO:103), T59832_T15 (SEQ ID NO:104), T59832_T6 (SEQ ID NO:107) and T59832_T8 (SEQ ID NO:108). Table 48 below describes the starting and ending position of this segment on each transcript. TABLE-US-00301 TABLE 48 Segment location on transcripts Segment Segment Transcript name starting position ending position T59832_T11 (SEQ ID 302 337 NO: 103) T59832_T15 (SEQ ID 302 337 NO: 104) T59832_T6 (SEQ ID NO: 107) 1368 1403 T59832_T8 (SEQ ID NO: 108) 302 337

Variant protein alignment to the previously known protein:
Sequence name: /tmp/YQPBtaxsLQ/JxSZR3ZR2p:GILT_HUMAN (SEQ ID NO:142)
Sequence documentation:

Alignment of: T59832_P5 (SEQ ID NO:143).times. GILT_HUMAN (SEQ ID NO:142).

Alignment segment 1/1: TABLE-US-00302 Quality: 429.00 Escore: 0 Matching length: 46 Total length: 46 Matching Percent 97.83 Matching Percent Identity: 97.83 Similarity: Total Percent Similarity: 97.83 Total Percent Identity: 97.83 Gaps: 0

```
Alignment: TABLE-US-00303 . . . 1
MTLSPLLLFLPPLLLLLDVPTAAVQASPLQALDFFGNGPPVNYKVG    46
||||||||||||||||||||||||||||||||||||||||||| |    12
MTLSPLLLFLPPLLLLLDVPTAAVQASPLQALDFFGNGPPVNYKTG    57
```

Sequence name: /tmp/9HrQ57oZGO/ugNVzp0I7X:GILT_HUMAN (SEQ ID NO:142)
Sequence documentation:

Alignment of: T59832_P7 (SEQ ID NO:144).times. GILT_HUMAN (SEQ ID NO:142).

Alignment segment 1/1: TABLE-US-00304 Quality: 2110.00 Escore: 0 Matching length: 212 Total length: 212 Matching Percent 100.00 Matching Percent Identity: 100.00 Similarity: Total Percent Similarity: 100.00 Total Percent Identity: 100.00 Gaps: 0

```
Alignment: TABLE-US-00305 . . . 1
MTLSPLLLFLPPLLLLLDVPTAAVQASPLQALDFFGNGPPVNYKTGNLYL    50
||||||||||||||||||||||||||||||||||||||||||||||||    12
MTLSPLLLFLPPLLLLLDVPTAAVQASPLQALDFFGNGPPVNYKTGNLYL    61 . . . 51

RGPLKKSNAPLVNVTLYYEALCGGCRAFLIRELFPTWLLVMEILNVTLVP    100
||||||||||||||||||||||||||||||||||||||||||||||||    62
RGPLKKSNAPLVNVTLYYEALCGGCRAFLIRELFPTWLLVMEILNVTLVP    111 . . . 101

YGNAQEQNVSGRWEFKCQHGEEECKFNKVEACVLDELDMELAFLTIVCME    150
||||||||||||||||||||||||||||||||||||||||||||||||    112
YGNAQEQNVSGRWEFKCQHGEEECKFNKVEACVLDELDMELAFLTIVCME    161 . . . 151

EFEDMERSLPLCLQLYAPGLSPDTIMECAMGDRGMQLMHANAQRTDALQP    200
||||||||||||||||||||||||||||||||||||||||||||||||    162
EFEDMERSLPLCLQLYAPGLSPDTIMECAMGDRGMQLMHANAQRTDALQP    211 . . . 201

PHEYVPWVTVNG    212
||||||||||    212
PHEYVPWVTVNG    223
```

Sequence name: /tmp/9HrQ57oZG0/ugNVzp0I7X:BAC98466 (SEQ ID NO:848)
Sequence documentation:
Alignment of: T59832_P7 (SEQ ID NO:144).times. BAC98466 (SEQ ID NO:848).

Alignment segment 1/1: TABLE-US-00306 Quality: 2110.00 Escore: 0 Matching length: 212 Total length: 212 Matching Percent 100.00 Matching Percent Identity: 100.00 Similarity: Total -Percent Similarity: 100.00 Total Percent Identity: 100.00 Gaps: 0

```
Alignment: TABLE-US-00307 . . . 1
MTLSPLLLFLPPLLLLLDVPTAAVQASPLQALDFFGNGPPVNYKTGNLYL    50
||||||||||||||||||||||||||||||||||||||||||||||||    1
MTLSPLLLFLPPLLLLLDVPTAAVQASPLQALDFFGNGPPVNYKTGNLYL    50 . . . 51

RGPLKKSNAPLVNVTLYYEALCGGCRAFLIRELFPTWLLVMEILNVTLVP    100
||||||||||||||||||||||||||||||||||||||||||||||||    51
RGPLKKSNAPLVNVTLYYEALCGGCRAFLIRELFPTWLLVMEILNVTLVP    100 . . . 101

YGNAQEQNVSGRWEFKCQHGEEECKFNKVEACVLDELDMELAFLTIVCME    150
||||||||||||||||||||||||||||||||||||||||||||||||    101
```

```
                                        -continued
YGNAQEQNVSGRWEFKCQHGEEECKFNKVEACVLDELDMELAFLTIVCME   150...151

EFEDMERSLPLCLQLYAPGLSPDTIMECAMGDRGMQLMHANAQRTDALQP   200
||||||||||||||||||||||||||||||||||||||||||||||||||  151
EFEDMERSLPLCLQLYAPGLSPDTIMECAMGDRGMQLMHANAQRTDALQP   200.201

PHEYVPWVTVNG                                         212
||||||||||||                                         201
PHEYVPWVTVNG                                         212
```

Sequence name: /tmp/9HrQ57oZG0/ugNVzp0I7X: BAC85622 (SEQ ID NO:849)

Sequence documentation:
Alignment of: T59832_P7 (SEQ ID NO:144).times. BAC85622 (SEQ ID NO:849).
Alignment segment 1/1: TABLE-US-00308 Quality: 1496.00 Escore: 0 Matching length: 148 Total length: 148 Matching Percent 100.00 Matching Percent Identity: 100.00 Similarity: Total -Percent Similarity: 100.00 Total Percent Identity: 100.00 Gaps: 0

```
Alignment: TABLE-US-00309 . . . 91
MEILNVTLVPYGNAQEQNVSGRWEFKCQHGEEECKFNKVEACVLDELDME   140
||||||||||||||||||||||||||||||||||||||||||||||||||   1
MEILNVTLVPYGNAQEQNVSGRWEFKCQHGEEECKFNKVEACVLDELDME    50...141

LAFLTIVCMEEFEDMERSLPLCLQLYAPGLSPDTIMECAMGDRGMQLMHA   190
||||||||||||||||||||||||||||||||||||||||||||||||||   51
LAFLTIVCMEEFEDMERSLPLCLQLYAPGLSPDTIMECAMGDRGMQLMHA   100...191

NAQRTDALQPPHEYVPWVTVNGVRIFLALSLTLIVPWSQGWTRQRDQR     238
|||||||||||||||||||||||||||||||||||||||||||||||     101
NAQRTDALQPPHEYVPWVTVNGVRIFLALSLTLIVPWSQGWTRQRDQR     148
```

Sequence name: /tmp/9HrQ57oZG0/ugNVzp0I7X: Q8WU77 (SEQ ID NO:850)

Sequence documentation:
Alignment of: T59832_P7 (SEQ ID NO:144).times. Q8WU77 (SEQ ID NO:850).
Alignment segment 1/1: TABLE-US-00310 Quality: 2110.00 Escore: 0 Matching length: 212 Total length: 212 Matching Percent 100.00 Matching Percent Identity: 100.00 Similarity: Total Percent Similarity: 100.00 Total Percent Identity: 100.00 Gaps: 0

Sequence name: /tmp/IttCiW30od/felXLDs4rU: GILT_HUMAN (SEQ ID NO:142)

Sequence documentation:
Alignment of: T59832_P9 (SEQ ID NO:145).times. GILT_HUMAN (SEQ ID NO:142).
Alignment segment 1/1: TABLE-US-00312 Quality: 2016.00 Escore: 0 Matching length: 203 Total length: 203 Matching Percent 100.00 Matching Percent Identity: 100.00 Similarity: Total Percent Similarity: 100.00 Total Percent Identity: 100.00 Gaps: 0

```
Alignment: TABLE-US-00311 . . . 1
MTLSPLLLFLPPLLLLLDVPTAAVQASPLQALDFFGNGPPVNYKTGNLYL    50
||||||||||||||||||||||||||||||||||||||||||||||||||   1
MTLSPLLLFLPPLLLLLDVPTAAVQASPLQALDFFGNGPPVNYKTGNLYL    50...51

RGPLKKSNAPLVNVTLYYEALCGGCRAFLIRELFPTWLLVMEILNVTLVP   100
||||||||||||||||||||||||||||||||||||||||||||||||||   51
RGPLKKSNAPLVNVTLYYEALCGGCRAFLIRELFPTWLLVMEILNVTLVP   100...101

YGNAQEQNVSGRWEFKCQHGEEECKFNKVEACVLDELDMELAFLTIVCME   150
||||||||||||||||||||||||||||||||||||||||||||||||||   101
YGNAQEQNVSGRWEFKCQHGEEECKFNKVEACVLDELDMELAFLTIVCME   150...151

EFEDMERSLPLCLQLYAPGLSPDTIMECAMGDRGMQLMHANAQRTDALQP   200
||||||||||||||||||||||||||||||||||||||||||||||||||   151
EFEDMERSLPLCLQLYAPGLSPDTIMECAMGDRGMQLMHANAQRTDALQP   200...201

PHEYVPWVTVNG                                         212
||||||||||||                                         201
PHEYVPWVTVNG                                         212
```

```
Alignment: TABLE-US-00313 . . . 1
MTLSPLLLFLPPLLLLLDVPTAAVQASPLQALDEFGNGPPVNYKTGNLYL    50
||||||||||||||||||||||||||||||||||||||||||||||||     12
MTLSPLLLFLPPLLLLLDVPTAAVQASPLQALDFFGNGPPVNYKTGNLYL    61 . . . 51

RGPLKKSNAPLVNVTLYYEALCGGCRAFLIRELFPTWLLVMEILNVTLVP   100
||||||||||||||||||||||||||||||||||||||||||||||||||   62
RGPLKKSNAPLVNVTLYYEALCGGCRAFLIRELFPTWLLVMEILNVTLVP   111 . . . 101

YGNAQEQNVSGRWEFKCQHGEEECKFNKVEACVLDELDMELAFLTIVCME   150
||||||||||||||||||||||||||||||||||||||||||||||||||   112
YGNAQEQNVSGRWEFKCQHGEEECKFNKVEACVLDELDMELAFLTIVCME   161 . . . 151

EFEDMERSLPLCLQLYAPGLSPDTIMECAMGDRGMQLMHANAQRTDALQP   200
||||||||||||||||||||||||||||||||||||||||||||||||||   162
EFEDMERSLPLCLQLYAPGLSPDTIMECAMGDRGMQLMHANAQRTDALQP   211 . . . 201

PHE                                                 203
|||                                                 212
PHE                                                 214
```

Sequence name: /tmp/IttCiW30od/felXLDs4rU: BAC98466 (SEQ ID NO:848)

Sequence documentation:

Alignment of: T59832_P9 (SEQ ID NO:145).times. BAC98466 (SEQ ID NO:848).

Alignment segment 1/1: TABLE-US-00314 Quality: 2016.00 Escore: 0 Matching length: 203 Total length: 203 Matching Percent 100.00 Matching Percent Identity: 100.00 Similarity: Total Percent Similarity: 100.00 Total Percent Identity: 100.00 Gaps: 0

```
Alignment: TABLE-US-00315 . . . 1
MTLSPLLLFLPPLLLLLDVPTAAVQASPLQALDFFGNGPPVNYKTGNLYL    50
||||||||||||||||||||||||||||||||||||||||||||||||||    1
MTLSPLLLFLPPLLLLLDVPTAAVQASPLQALDFFGNGPPVNYKTGNLYL    50 . . . 51

RGPLKKSNAPLVNVTLYYEALCGGCRAFLIRELFPTWLLVMEILNVTLVP   100
||||||||||||||||||||||||||||||||||||||||||||||||||   51
RGPLKKSNAPLVNVTLYYEALCGGCRAFLIRELFPTWLLVMEILNVTLVP   100 . . . 101

YGNAQEQNVSGRWEFKCQHGEEECKFNKVEACVLDELDMELAFLTIVCME   150
||||||||||||||||||||||||||||||||||||||||||||||||||   101
YGNAQEQNVSGRWEFKCQHGEEECKFNKVEACVLDELDMELAFLTIVCME   150 . . . 151

EFEDMERSLPLCLQLYAPGLSPDTIMECAMGDRGMQLMHANAQRTDALQP   200
||||||||||||||||||||||||||||||||||||||||||||||||||   151
EFEDMERSLPLCLQLYAPGLSPDTIMECAMGDRGMQLMHANAQRTDALQP   200 . . . 201

PHE                                                 203
|||                                                 201
PHE                                                 203
```

Sequence name: /tmp/IttCiW30od/felXLDs4rU: BAC85622 (SEQ ID NO:849)

Sequence documentation:

Alignment of: T59832_P9 (SEQ ID NO:145).times. BAC85622 (SEQ ID NO:849).

Alignment segment 1/1: TABLE-US-00316 Quality: 1145.00 Escore: 0 Matching length: 113 Total length: 113 Matching Percent 100.00 Matching Percent Identity: 100.00 Similarity: Total Percent Similarity: 100.00 Total Percent Identity: 100.00 Gaps: 0

```
Alignment: TABLE-US-00317 . . . 91
MEILNVTLVPYGNAQEQNVSGRWEFKCQHGEEECKENKVEACVLDELDME   140
|||||||||||||||||||||||||||||||||||| |||||||||||||    1
MEILNVTLVPYGNAQEQNVSGRWEFKCQHGEEECKFNKVEACVLDELDME    50 . . . 141

LAFLTIVCMEEFEDMERSLPLCLQLYAPGLSPDTIMECAMGDRGMQLMHA   190
||||||||||||||||||||||||||||||||||||||||||||||||||   51
LAFLTIVCMEEFEDMERSLPLCLQLYAPGLSPDTIMECAMGDRGMQLMHA   100 . . . 191

NAQRTDALQPPHE                                       203
|||||||||||||                                       101
NAQRTDALQPPHE                                       113
```

Sequence name: /tmp/IttCiW30od/felXLDs4rU:Q8WU77 (SEQ ID NO:850)

Sequence documentation:

Alignment of: T59832_P9 (SEQ ID NO:145).times. Q8WU77 (SEQ ID NO:850).

Alignment segment 1/1: TABLE-US-00318 Quality: 2016.00 Escore: 0 Matching length: 203 Total length: 203 Matching Percent 100.00 Matching Percent Identity: 100.00 Similarity: Total Percent Similarity: 100.00 Total Percent Identity: 100.00 Gaps: 0

```
Alignment: TABLE-US-00319 . . . 1
MTLSPLLLFLPPLLLLLDVPTAAVQASPLQALDFFGNGPPVNYKTGNLYL  50
||||||||||||||||||||||||||||||||||||||||||||||||||  1
MTLSPLLLFLPPLLLLLDVPTAAVQASPLQALDFFGNGPPVNYKTGNLYL  50 . . . 51

RGPLKKSNAPLVNVTLYYEALCGGCRAFLIRELFPTWLLVMEILNVTLVP  100
||||||||||||||||||||||||||||||||||||||||||||||||||  51
RGPLKKSNAPLVNVTLYYEALCGGCRAFLIRELFPTWLLVMEILNVTLVP  100 . . . 101

YGNAQEQNVSGRWEFKCQHGEEECKFNKVEACVLDELDMELAFLTIVCME  150
||||||||||||||||||||||||||||||||||||||||||||||||||  101
YGNAQEQNVSGRWEFKCQHGEEECKFNKVEACVLDELDMELAFLTIVCME  150 . . . 151

EFEDMERSLPLCLQLYAPGLSPDTIMECAMGDRGMQLMHANAQRTDALQP  200
||||||||||||||||||||||||||||||||||||||||||||||||||  151
EFEDMERSLPLCLQLYAPGLSPDTIMECAMGDRGMQLMHANAQRTDALQP  200 201

PHE  203
|||  201
PHE  203
```

Sequence name: /tmp/sIHTwdduiK/ToMKmEJiZc: GILT_HUMAN (SEQ ID NO:142)

Sequence documentation:

Alignment of: T59832_P12 (SEQ ID NO:146).times. GILT_HUMAN (SEQ ID NO:142).

Alignment segment 1/1: TABLE-US-00320 Quality: 2084.00 Escore: 0 Matching length: 219 Total length: 250 Matching Percent 100.00 Matching Percent Identity: 100.00 Similarity: Total Percent Similarity: 87.60 Total Percent Identity: 87.60 Gaps: 1

```
Alignment: TABLE-US-00321 1
MTLSPLLLFLPPLLLLLDVPTAAVQASPLQALDFFGNGPPVNYKTGNLYL  50
||||||||||||||||||||||||||||||||||||||||||||||||||  12
MTLSPLLLFLPPLLLLLDVPTAAVQASPLQALDFFGNGPPVNYKTGNLYL  61 . . . 51

RGPLKKSNAPLVNVTLYYEALCGGCRAFLIRELFPTWLLVMEILNVTLVP  100
||||||||||||||||||||||||||||||||||||||||||||||||||  62
RGPLKKSNAPLVNVTLYYEALCGGCRAFLIRELFPTWLLVMEILNVTLVP  111 . . . 101

YGNAQEQNVSGRWEFKCQHGEEECKFNKVE....................  130
|||||||||||||||||||||||||||||                       112
YGNAQEQNVSGRWEFKCQHGEEECKFNKVEACVLDELDMELAFLTIVCME  161 . . . 131

...........CLQLYAPGLSPDTIMECAMGDRGMQLMHANAQRTDALQP  169
            |||||||||||||||||||||||||||||||||||||||  162
EFEDMERSLPLCLQLYAPGLSPDTIMECAMGDRGMQLMHANAQRTDALQP  211 . . . 170

PHEYVPWVTVNGKPLEDQTQLLTLVCQLYQGKKPDVCPSSTSSLRSVCFK  219
||||||||||||||||||||||||||||||||||||||||||||||||||  212
PHEYVPWVTVNGKPLEDQTQLLTLVCQLYQGKKPDVCPSSTSSLRSVCFK  261
```

Sequence name: /tmp/sIHTwdduiK/ToMKmEJiZc: BAC85622 (SEQ ID NO:849)

Sequence documentation:

Alignment of: T59832_P12 (SEQ ID NO:146).times. BAC85622 (SEQ ID NO:849).

Alignment segment 1/1: TABLE-US-00322 Quality: 835.00 Escore: 0 Matching length: 91 Total length: 122 Matching Percent 100.00 Matching Percent Identity: 100.00 Similarity: Total Percent Similarity: 74.59 Total Percent Identity: 74.59 Gaps: 1

```
Alignment: TABLE-US-00323 . . . 91
MEILNVTLVPYGNAQEQNVSGRWEFKCQHGEEECKFNKVE..........  130
||||||||||||||||||||||||||||||||||||||||            1
MEILNVTLVPYGNAQEQNVSGRWEFKCQHGEEECKFNKVEACVLDELDME   50 . . . 131

...................CLQLYAPGLSPDTIMECAMGDRGMQLMHA    159
                   |||||||||||||||||||||||||||||     51
LAFLTIVCMEEFEDMERSLPLCLQLYAPGLSPDTIMECAMGDRGMQLMHA  100 . . . 160

NAQRTDALQPPHEYVPWVTVNG                              181
||||||||||||||||||||||                              101
NAQRTDALQPPHEYVPWVTVNG                              122
```

Sequence name: /tmp/sIHTwdduiK/ToMKmEJiZc: Q8WU77 (SEQ ID NO:850)

Sequence documentation:

Alignment of: T59832_P12 (SEQ ID NO:146).times. Q8WU77 (SEQ ID NO:850).

Alignment segment 1/1: TABLE-US-00324 Quality: 2084.00 Escore: 0 Matching length: 219 Total length: 250 Matching Percent 100.00 Matching Percent Identity: 100.00 Similarity: Total Percent Similarity: 87.60 Total Percent Identity: 87.60 Gaps: 1

Sequence name: /tmp/LH4xf8J65f/a95JQoTfNB: GILT_HUMAN (SEQ ID NO:142)

Sequence documentation:

Alignment of: T59832_P18 (SEQ ID NO:147).times. GILT_HUMAN (SEQ ID NO:142).

Alignment segment 1/1: TABLE-US-00326 Quality: 1222.00 Escore: 0 Matching length: 133 Total length: 250 Matching Percent 100.00 Matching Percent Identity: 100.00

```
Alignment: TABLE-US-00325 . . . 1
MTLSPLLLFLPPLLLLLDVPTAAVQASPLQALDFFGNGPPVNYKTGNLYL   50
|||||||||||||||||||||||||||||||||||||||||||||||||    1
MTLSPLLLFLPPLLLLLDVPTAAVQASPLQALDFFGNGPPVNYKTGNLYL   50 . . . 51

RGPLKKSNAPLVNVTLYYEALCGGCRAFLIRELFPTWLLVMEILNVTLVP  100
|||||||||||||||||||||||||||||||||||||||||||||||||   51
RGPLKKSNAPLVNVTLYYEALCGGCRAFLIRELFPTWLLVMEILNVTLVP  100 . . . 101

YGNAQEQNVSGRWEFKCQHGEEECKFNKVE....................  130
|||||||||||||||||||||||||||||                      101
YGNAQEQNVSGRWEFKCQHGEEECKFNKVEACVLDELDMELAFLTIVCME  150 . . . 131

...........CLQLYAPGLSPDTIMECAMGDRCMQLMHANAQRTDALQP  169
           |||||||||||||||||||||| |||||||||||||||  151
EFEDMERSLPLCLQLYAPGLSPDTIMECAMGDRGMQLMHANAQRTDALQP  200 . . . 170

PHEYVPWVTVNGKPLEDQTQLLTLVCQLYQGKKPDVCPSSTSSLRSVCFK  219
|||||||||||||||||||||||||||||||||||||||||||||||||  201
PHEYVPWVTVNGKPLEDQTQLLTLVCQLYQGKKPDVCPSSTSSLRSVCFK  250
```

Similarity: Total Percent Similarity: 53.20 Total Percent Identity: 53.20 Gaps: 1

```
Alignment: TABLE-US-00327 . . . 1
MTLSPLLLFLPPLLLLLDVPTAAVQASPLQALDFFGNGPPVNYK......   44
|||||||||||||||||||||||||||||||||||||||||||          12
MTLSPLLLFLPPLLLLLDVPTAAVQASPLQALDFFGNGPPVNYKTGNLYL   61 . . . 44

..................................................   44  62
RGPLKKSNAPLVNVTLYYEALCGGCRAFLIRELFPTWLLVMEILNVTLVP  111 . . . 44

..................................................   44 112
YGNAQEQNVSGRWEFKCQHGEEECKFNKVEACVLDELDMELAFLTIVCME  161 . . . 45

...........CLQLYAPGLSPDTIMECAMGDRGMQLMHANAQRTDALQP   83
           |||||||||||||||||||||||||||||||||||||||  162
EFEDMERSLPLCLQLYAPGLSPDTIMECAMGDRGMQLMHANAQRTDALQP  211 . . . 84

PHEYVPWVTVNGKPLEDQTQLLTLVCQLYQGKKPDVCPSSTSSLRSVCFK  133
|||||||||||||||||||||||||||||||||||||||||||||||||  212
PHEYVPWVTVNGKPLEDQTQLLTLVCQLYQGKKPDVCPSSTSSLRSVCFK  261
```

Sequence name: /tmp/LH4xf8J65f/a95JQoTfNB: Q8WU77 (SEQ ID NO:850)
Sequence documentation:
Alignment of: T59832_P18 (SEQ ID NO:147).times. Q8WU77 (SEQ ID NO:850).
Alignment segment 1/1: TABLE-US-00328 Quality: 1222.00 Escore: 0 Matching length: 133 Total length: 250 Matching Percent 100.00 Matching Percent Identity: 100.00 Similarity: Total Percent Similarity: 53.20 Total Percent Identity: 53.20 Gaps: 1

```
Alignment: TABLE-US-00329 . . . 1
MTLSPLLLFLPPLLLLLDVPTAAVQASPLQALDFFGNGPPVNYK......    44
|||||||||||||||||||||||||||||||||||||||||||            1
MTLSPLLLFLPPLLLLLDVPTAAVQASPLQALDFFGNGPPVNYKTGNLYL    50 . . . 44

..................................................   44  51
RGPLKKSNAPLVNVTLYYEALCGGCRAFLIRELFPTWLLVMEILNVTLVP    100 . . . 44

..................................................   44  101
YGNAQEQNVSGRWEFKCQHGEEECKFNKVEACVLDELDMELAFLTIVCME    150 . . . 45

...........CLQLYAPGLSPDTIMECAMGDRGMQLMHANAQRTDALQP     83
            ||||||||||||||||||||||||||||||||||||||    151
EFEDMERSLPLCLQLYAPGLSPDTIMECAMGDRGMQLMHANAQRTDALQP    200 . . . 84

PHEYVPWVTVNGKPLEDQTQLLTLVCQLYQGKKPDVCPSSTSSLRSVCFK    133
||||||||||||||||||||||||||||||||||||||||||||||||||   201
PHEYVPWVTVNGKPLEDQTQLLTLVCQLYQGKKPDVCPSSTSSLRSVCFK    250
```

Sequence name: /tmp/LH4xf8J65f/a95JQoTfNB:Q8NEI4 (SEQ ID NO:851)
Sequence documentation:
Alignment of: T59832-P18 (SEQ ID NO:147).times. Q8NEI4 (SEQ ID NO:851).
Alignment segment 1/1: TABLE-US-00330 Quality: 1222.00 Escore: 0 Matching length: 133 Total length: 250 Matching Percent 100.00 Matching Percent Identity: 100.00 Similarity: Total Percent Similarity: 53.20 Total Percent Identity: 53.20 Gaps: 1

```
Alignment: TABLE-US-00331 . . . 1
MTLSPLLLFLPPLLLLLDVPTAAVQASPLQALDFFGNGPPVNYK......    44
|||||||||||||||||||||||||||||||||||||||||||            1
MTLSPLLLFLPPLLLLLDVPTAAVQASPLQALDFFGNGPPVNYKTGNLYL    50 . . . 44

..................................................   44  51
RGPLKKSNAPLVNVTLYYEALCGGCQAFLIRELFPTWLLVMEILNVTLVP    100 . . . 44

..................................................   44  101
YGNAQEQNVSGRWEFKCQHGEEECKFNKVEACVLDELDMELAFLTIVCME    150 . . . 45

...........CLQLYAPGLSPDTIMECAMGDRGMQLMHANAQRTDALQP     83
            ||||||||||||||||||||||||||||||||||||||    151
EFEDMERSLPLCLQLYAPGLSPDTIMECAMGDRGMQLMHANAQRTDALQP    200 . . . 84

PHEYVPWVTVNGKPLEDQTQLLTLVCQLYQGKKPDVCPSSTSSLRSVCFK    133
||||||||||||||||||||||||||||||||||||||||||||||||||   201
PHEYVPWVTVNGKPLEDQTQLLTLVCQLYQGKKPDVCPSSTSSLRSVCFK    250
```

Expression of Gamma-Interferon Inducible Lysosomal Thiol Reductase (GILT) T59832 Transcripts which are Detectable by Amplicon as Depicted in Sequence Name T59832junc6-25-26 (SEQ ID NO:854) in Normal and Cancerous Breast Tissues Expression of gamma-interferon inducible lysosomal thiol reductase (GILT) transcripts detectable by or according to junc6-25-26, T59832junc6-25-26 (SEQ ID NO:854) amplicon and primers T59832junc6-25-26F (SEQ ID NO:852) T59832junc6-25-26R (SEQ ID NO:853) was measured by real time PCR. In parallel the expression of four housekeeping genes-PBGD (GenBank Accession No. BC019323 (SEQ ID NO:926); amplican-PBGD-amplicon (SEQ ID NO:929)), HPRT1 (GenBank Accession No. NM.sub.--000194 (SEQ ID NO:930); amplican-HPRT1-amplicon (SEQ ID NO:933)), SDHA (GenBank Accession No. NM.sub.--004168 (SEQ ID NO:922); amplican-SDHA-amplicon (SEQ ID NO :925)), G6PD (GenBank Accession No. NM.sub.--000402 (SEQ ID NO:918); G6PD-amplicon (SEQ ID NO:921)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 1 above, "Tissue samples in testing panel", above), to obtain a value of fold up-regulation for each sample relative to median of the normal PM samples.

Figure 18:
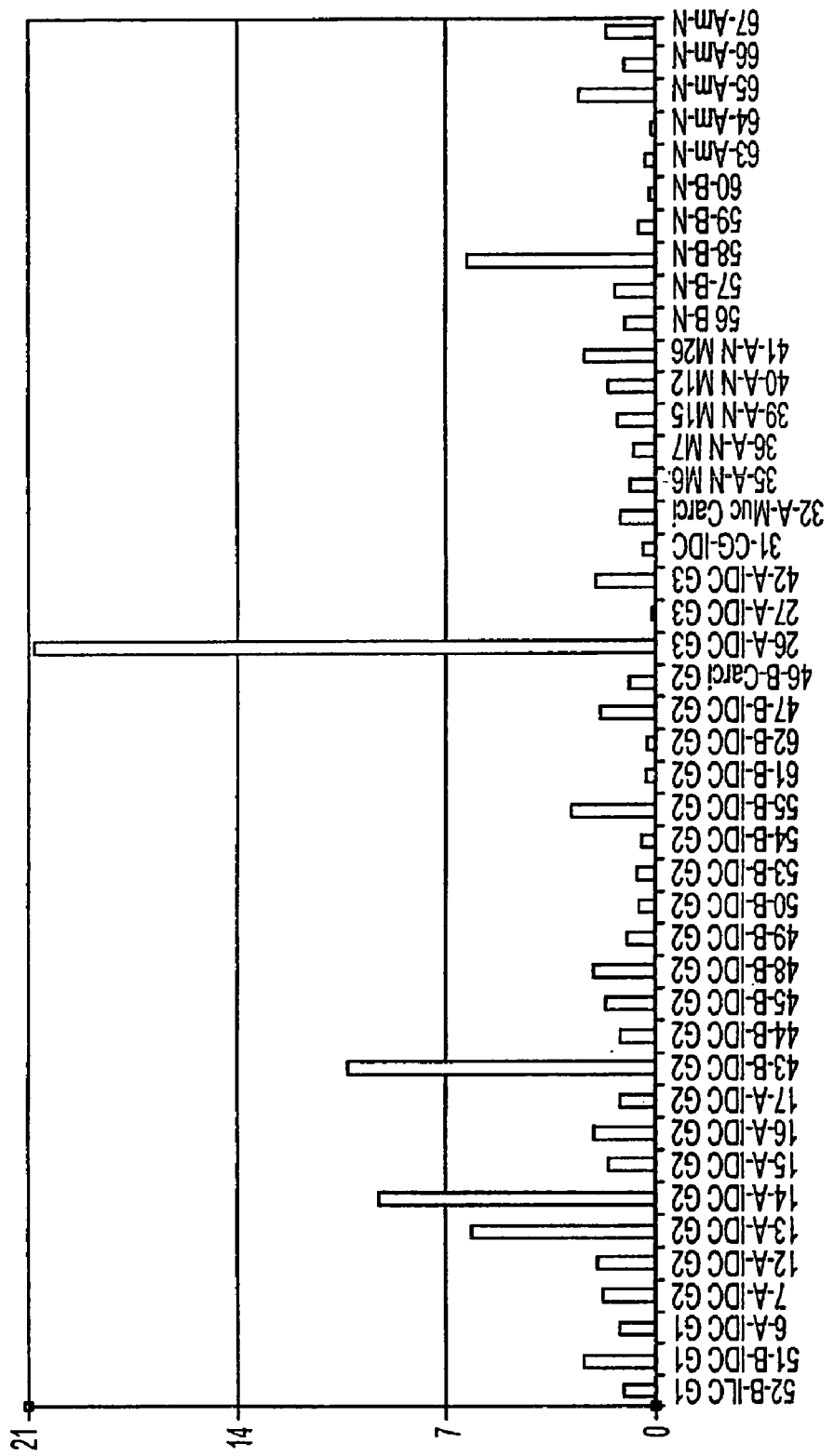
FIG. 18 is a histogram showing low over expression observed for cluster T59832, amplicon name: T59832 junc6-25-26 (SEQ ID NO:854), in one experiment carried out with breast cancer samples panel.

FIG. 18 is a histogram showing over expression of the above-indicated gamma-interferon inducible lysosomal thiol reductase (GILT) transcripts in cancerous breast samples relative to the normal samples.

As is evident from FIG. 18, the expression of gamma-interferon inducible lysosomal thiol reductase (GILT) transcripts detectable by the above amplicon(s) in cancer samples was higher in a few samples than in the non-cancerous samples (Sample Nos. 56-60, 63-67, Table 1 above, "Tissue samples in testing panel"). Notably an over-expression of at least 7 fold was found in 3 out of 28 adenocarcinoma samples.

Primer pairs are also optionally and preferably encompassed within the present invention; for example, for the above experiment, the following primer pair was used as a non-limiting illustrative example only of a suitable primer pair: T59832junc6-25-26F forward primer (SEQ ID NO:852); and T59832junc6-25-26R reverse primer (SEQ ID NO:853).

The present invention also preferably encompasses any amplicon obtained through the use of any suitable primer pair; for example, for the above experiment, the following amplicon was obtained as a non-limiting illustrative example only of a suitable amplicon: T59832junc6-25-26 (SEQ ID NO:854). TABLE-US-00332 Forward primer T59832junc6-25-26F: (SEQ ID NO: 852) CCACCAGTTMCTACMGT-GCCTG Reverse primer T59832junc6-25-26R: (SEQ ID NO: 853) GCGTGCATGAGCTGCATG Amplicon T59832junc6-25-26: (SEQ ID NO: 854) CCACCAGTTMC-TACMGTGCCTGCAGCTCTACGC-CCCAGGGCTGTCGCCAGACAC TATCATGGAGTGT-GCMTGGGGGACCGCGGCATGCAGCTCATGCACGC Description for Cluster HUMGRP5E Cluster HUMGRP5E features 2 transcript(s) and 5 segment(s) of interest, the names for which are given in Tables 1 and 2, respectively, the sequences themselves are given at the end of the application. The selected protein variants are given in table 3. TABLE-US-00333 TABLE 1 Transcripts of interest Transcript Name Sequence ID No. HUMGRP5E_T4 148 HUMGRP5E_T5 149

TABLE-US-00334 TABLE 2 Segments of interest Segment Name Sequence ID No. HUMGRP5E_node__0 150 HUMGRP5E_node__2 151 HUMGRP5E_node__8 152 HUMGRP5E_node__3 153 HUMGRP5E_node__7 154

TABLE-US-00335 TABLE 3 Proteins of interest Protein Name Sequence ID No. HUMGRP5E_P4 156 HUMGRP5E_P5 157

These sequences are variants of the known protein Gastrin-releasing peptide precursor (SEQ ID NO: 155) (SwissProt accession identifier GRP_HUMAN; known also according to the synonyms GRP; GRP-10), SEQ ID NO: 155, referred to herein as the previously known protein.

Gastrin-releasing peptide is known or believed to have the following function(s): stimulates gastrin release as well as other gastrointestinal hormones. The sequence for protein Gastrin-releasing peptide precursor (SEQ ID NO:155) is given at the end of the application, as "Gastrin-releasing peptide precursor (SEQ ID NO:155) amino acid sequence". Known polymorphisms for this sequence are as shown in Table 4. TABLE-US-00336 TABLE 4 Amino acid mutations for Known Protein SNP position(s) on amino acid sequence Comment 4 S→R Protein Gastrin-releasing peptide localization is believed to be Secreted.

The previously known protein also has the following indication(s) and/or potential therapeutic use(s): Diabetes, Type II. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Bombesin antagonist; Insulinotropin agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anorectic/Antiobesity; Releasing hormone; Anticancer; Respiratory; Antidiabetic.

The following GO Annotation(s) apply to the previously known protein. The following annotation(s) were found: signal transduction; neuropeptide signaling pathway, which are annotation(s) related to Biological Process; growth factor, which are annotation(s) related to Molecular Function; and secreted, which are annotation(s) related to Cellular Component.

The GO assignment relies on information from one or more of the SwissProt/TremBI Protein knowledgebase, available from; or Locuslink, available from ncbi.nim.nih.gov/projects/LocusLink/.

As noted above, cluster HUMGRP5E features 2 transcript(s), which were listed in Table 1 above. These transcript(s) encode for protein(s) which are variant(s) of protein Gastrin-releasing peptide precursor (SEQ ID NO:155). A description of each variant protein according to the present invention is now provided.

Variant protein HUMGRP5E_P4 (SEQ ID NO:156) according to the present invention has an amino acid sequence as given at the end of the application; it is encoded by transcript(s) HUMGRP5E_T4 (SEQ ID NO:148). An alignment is given to the known protein (Gastrin-releasing peptide precursor (SEQ ID NO:155) ) at the end of the application. One or more alignments to one or more previously published protein sequences are given at the end of the application. A brief description of the relationship of the variant protein according to the present invention to each such aligned protein is as follows:

Comparison report between HUMGRP5E_P4 (SEQ ID NO:156) and GRP_HUMAN (SEQ ID NO:155):

1.An isolated chimeric polypeptide encoding for HUMGRP5E_P4 (SEQ ID NO:156), comprising a first amino acid sequence being at least 90% homologous to MRGSELPLVLLALVLCLAPRGRAV-PLPAGGGTVLTKMYPRGNHWAVGHLMGKKSTG ESSSVSERGSLKQQLREYIRWEEAARN-LLGLIEAKENRNHQPPQPKALGNQQPSWDSED SSN-FKDVGSKGK corresponding to amino acids 1-127 of GRP_HUMAN (SEQ ID NO:155), which also corresponds to amino acids 1-127 of HUMGRP5E_P4 (SEQ ID NO:156), and a second amino acid sequence being at least 90% homologous to GSQREGRNPQLNQQ corresponding to amino acids 135-148 of GRP_HUMAN (SEQ ID NO:155), which also corresponds to amino acids 128-141 of HUMGRP5E_P4 (SEQ ID NO:156), wherein said first and second amino acid sequences are contiguous and in a sequential order.

2.An isolated chimeric polypeptide encoding for an edge portion of HUMGRP5E_P4 (SEQ ID NO:156), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KG, having a structure as follows: a sequence starting from any of amino acid numbers 127-x to 127; and ending at any of amino acid numbers 128+((n−2)-x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGRP5E_P4 (SEQ ID NO:156) also has the following non-silent SNPs (Single Nucleotide Polymorphisms) as listed in Table 5, (given according to their position(s) on the amino acid sequence, with the alternative amino acid(s) listed; the last column indicates whether the SNP is known or not; the presence of known SNPs in variant protein HUMGRP5E_P4 (SEQ ID NO:156) sequence provides support for the deduced sequence of this variant protein according to the present invention). TABLE-US-00337 TABLE 5 Amino acid mutations SNP position(s) on amino acid Alternative sequence amino acid(s) Previously known SNP? 4 S→R Yes Variant protein HUMGRP5E_P4 (SEQ ID NO:156) is encoded by the following transcript(s): HUMGRP5E_T4 (SEQ ID NO:148), for which the sequence(s) is/are given at the end of the application. The coding portion of transcript HUMGRP5E_T4, (SEQ ID NO:148) is shown in bold; this coding portion starts at position 622 and ends at position 1044. The transcript also has the following SNPs as listed in Table 6 (given according to their position on the nucleotide sequence, with the alternative nucleic acid listed; the last column indicates whether the SNP is known or not; the presence of known SNPs in variant protein HUMGRP5E_P4 (SEQ ID NO:156) sequence provides support for the deduced sequence of this variant protein according to the present invention). TABLE-US-00338 TABLE 6 Nucleic acid SNPs SNP position on nucleotide Alternative sequence nucleic acid Previously known SNP? 541→T No 542 G→T No 631 A→C Yes 672 G→A Yes 1340 C→No 1340 C→A No 1341 A→No 1341 A→G No Variant protein HUMGRP5E_P5 (SEQ ID NO:157) according to the present invention has an amino acid sequence as given at the end of the application; it is encoded by transcript(s) HUMGRP5E_T5 (SEQ ID NO:149). An alignment is given to the known protein (Gastrin-releasing peptide precursor (SEQ ID NO:155) ) at the end of the application. One or more alignments to one or more previously published protein sequences are given at the end of the application. A brief description of the relationship of the variant protein according to the present invention to each such aligned protein is as follows:

Comparison report between HUMGRP5E_P5 (SEQ ID NO:157) and GRP_HUMAN (SEQ ID NO:155):

1. An isolated chimeric polypeptide encoding for HUMGRP5E_P5 (SEQ ID NO:157), comprising a first amino acid sequence being at least 90% homologous to MRGSELPLVLLALVLCLAPRGRAV-PLPAGGGTVLTKMYPRGNHWAVGHLMGKKSTG ESSSVSERGSLKQQLREYIRWEEAARN-LLGLIEAKENRNHQPPQPKALGNQQPSWDSED SSN-FKDVGSKGK corresponding to amino acids 1-127 of GRP_HUMAN (SEQ ID NO:155), which also corresponds to amino acids 1-127 of HUMGRP5E_P5 (SEQ ID NO:157), and a second amino acid sequence being at least 70%, optionally at least 80%, preferably at least 85%, more preferably at least 90% and most preferably at least 95% homologous to a polypeptide having the sequence DSLLQVLNVKEGTPS (SEQ ID NO:1017) corresponding to amino acids 128-142 of HUMGRP5E_P5 (SEQ ID NO:157), wherein said first and second amino acid sequences are contiguous and in a sequential order.

2. An isolated polypeptide encoding for a tail of HUMGRP5E_P5 (SEQ ID NO:157), comprising a polypeptide being at least 70%, optionally at least about 80%, preferably at least about 85%, more preferably at least about 90% and most preferably at least about 95% homologous to the sequence DSLLQVLNVKEGTPS (SEQ ID NO:1017) in HUMGRP5E_P5 (SEQ ID NO:157).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGRP5E_P5 (SEQ ID NO:157) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein HUMGRP5E_P5 (SEQ ID NO:157) sequence provides support for the deduced sequence of this variant protein according to the present invention). TABLE-US-00339 TABLE 7 Amino acid mutations SNP position(s) on amino acid Alternative sequence amino acid(s) Previously known SNP? 4 S→R Yes Variant protein HUMGRP5E_P5 (SEQ ID NO:157) is encoded by the following transcript(s): HUMGRP5E_T5 (SEQ ID NO:149), for which the sequence(s) is/are given at the end of the application. The coding portion of transcript HUMGRP5E_T5 (SEQ ID NO:149) is shown in bold; this coding portion starts at position 622 and ends at position 1047. The transcript also has the following SNPs as listed in Table 8 (given according to their position on the nucleotide sequence, with the alternative nucleic acid listed; the last column indicates whether the SNP is known or not; the presence of known SNPs in variant protein HUMGRP5E_P5 (SEQ ID NO:157) sequence provides support for the deduced sequence of this variant protein according to the present invention). TABLE-US-00340 TABLE 8 Nucleic acid SNPs SNP position on nucleotide Alternative sequence nucleic acid Previously known SNP? 541→T No 542 G→T No 631 A→C Yes 672 G→A Yes 1354 C→No 1354 C→A No 1355 A→No 1355 A→G No As noted above, cluster HUMGRP5E features 5 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMGRP5E_node.sub.--0 (SEQ ID NO:150) according to the present invention is supported by 21 libraries. The number of libraries was determined as previously described. This segment can be found in the following transcript(s): HUMGRP5E_T4 (SEQ ID NO:148) and HUMGRP5E_T5 (SEQ ID NO:149). Table 9 below describes the starting and ending position of this segment on each transcript. TABLE-US-00341 TABLE 9 Segment location on transcripts Segment starting Segment ending Transcript name position position HUMGRP5E_T4 1 760 (SEQ ID NO: 148) HUMGRP5E_T5 1 760 (SEQ ID NO: 149)

Segment cluster HUMGRP5E_node.sub.--2 (SEQ ID NO:151) according to the present invention is supported by 27 libraries. The number of libraries was determined as previously described. This segment can be found in the following transcript(s): HUMGRP5E_T4 (SEQ ID NO:148) and HUMGRP5E_T5 (SEQ ID NO:149). Table 10 below describes the starting and ending position of this segment on each transcript. TABLE-US-00342 TABLE 10 Segment location on transcripts Segment starting Segment ending Transcript name position position HUMGRP5E_T4 761 984 (SEQ ID NO: 148) HUMGRP5E_T5 761 984 (SEQ ID NO: 149)

Segment cluster HUMGRP5E_node.sub.--8 (SEQ ID NO:152) according to the present invention is supported by 26 libraries. The number of libraries was determined as previously described. This segment can be found in the following transcript(s): HUMGRP5E_T4 (SEQ ID NO:148) and HUMGRP5E_T5 (SEQ ID NO:149). Table 11 below describes the starting and ending position of this segment on each transcript. TABLE-US-00343 TABLE 11 Segment location on transcripts Segment starting Segment ending Transcript name position position HUMGRP5E_T4 1004 1362 (SEQ ID NO: 148) HUMGRP5E_T5 1018 1376 (SEQ ID NO: 149)

According to an optional embodiment of the present invention, short segments related to the above cluster are also provided. These segments are up to about 120 bp in length, and so are included in a separate description.

1003 (SEQ ID NO: 148) HUMGRP5E_T5 985 1003 (SEQ ID NO: 149)

Segment cluster HUMGRP5E_node.sub.--7 (SEQ ID NO:154) according to the present invention can be found in the following transcript(s): HUMGRP5E_T5 (SEQ ID NO:149). Table 13 below describes the starting and ending position of this segment on each transcript. TABLE-US-00345 TABLE 13 Segment location on transcripts Segment Segment Transcript name starting position ending position HUMGRP5E_T5 1004 1017 (SEQ ID NO:149)

Variant protein alignment to the previously known protein:

Sequence name: /tmp/412zs2mwyT/B0wjOUAX0d:GRP_ HUMAN (SEQ ID NO:155)

Sequence documentation:

Alignment of: HUMGRP5E_P4 (SEQ ID NO:156).times. GRP_HUMAN (SEQ ID NO:155).

Alignment segment 1/1: TABLE-US-00346 Quality: 1291.00 Escore: 0 Matching length: 141 Total length: 148 Matching Percent 100.00 Matching Percent Identity: 100.00 Similarity: Total Percent Similarity: 95.27 Total Percent Identity: 95.27 Gaps: 1

```
Alignment: TABLE-US-00347 . . . 1
MRGSELPLVLLALVLCLAPRGRAVPLPAGGGTVLTKMYPRGNHWAVGHLM  50
||||||||||||||||||||||||||||||||||||||||||||||||||  1
MRGSELPLVLLALVLCLAPRGRAVPLPAGGGTVLTKMYPRGNHWAVGHLM  50 . . . 51

GKKSTGESSSVSERGSLKQQLREYIRWEEAARNLLGLIEAKENRNHQPPQ  100
||||||||||||||||||||||||||||||||||||||||||||||||||  51
GKKSTGESSSVSERGSLKQQLREYIRWEEAARNLLGLIEAKENRNHQPPQ  100 . . . 101

PKALGNQQPSWDSEDSSNFKDVGSKGK.......GSQREGRNPQLNQQ   141
|||||||||||||||||||||||||||       |||||||||||||||  101
PKALGNQQPSWDSEDSSNFKDVGSKGKVGRLSAPGSQREGRNPQLNQQ   148
```

Sequence name: /tmp/1me9Idnvfv/KbP5io8PtU:GRP_HUMAN (SEQ ID NO:155)

Sequence documentation:

Alignment of: HUMGRP5E_P5 (SEQ ID NO:157).times. GRP HUMAN (SEQ ID NO:155).

Alignment segment 1/1: TABLE-US-00348 Quality: 1248.00 Escore: 0 Matching length: 127 Total length: 127 Matching Percent 100.00 Matching Percent Identity: 100.00 Similarity: Total Percent Similarity: 100.00 Total Percent Identity: 100.00 Gaps: 0

```
Alignment: TABLE-US-00349 . . . 1
MRGSELPLVLLALVLCLAPRGRAVPLPAGGGTVLTKMYPRGNHWAVGHLM  50
||||||||||||||||||||||||||||||||||||||||||||||||||  1
MRGSELPLVLLALVLCLAPRGRAVPLPAGGGTVLTKMYPRGNHWAVGHLM  50 . . . 51

GKKSTGESSSVSERGSLKQQLREYIRWEEAARNLLGLIEAKENRNHQPPQ  100
||||||||||||||||||||||||||||||||||||||||||||||||||  51
GKKSTGESSSVSERGSLKQQLREYIRWEEAARNLLGLIEAKENRNHQPPQ  100 . . . 101

PKALGNQQPSWDSEDSSNFKDVGSKGK   127
||||||||||||||||||||||||||    101
PKALGNQQPSWDSEDSSNFKDVGSKGK   127
```

Segment cluster HUMGRP5E_node.sub.--3 (SEQ ID NO:153) according to the present invention can be found in the following transcript(s): HUMGRP5E_T4 (SEQ ID NO:148) and HUMGRP5E_T5 (SEQ ID NO:149). Table 12 below describes the starting and ending position of this segment on each transcript. TABLE-US-00344 TABLE 12 Segment location on transcripts Segment starting Segment ending Transcript name position position HUMGRP5E_T4 985

Expression of GRP_HUMAN-Gastrin-Releasing Peptide (HUMGRP5E) Transcripts, which are Detectable by Amplicon, as Depicted in Sequence Name HUMGRP5Ejunc3-7 (SEQ ID NO:857) in Normal and Cancerous Breast Tissues Expression of GRP_HUMAN-gastrin-releasing peptide transcripts detectable by or according to junc3-7, HUMGRP5Ejunc3-7 (SEQ ID NO:857) amplicon(s) and HUMGRP5Ejunc3-7F (SEQ ID NO:855) and HUMGRP5Ejunc3-7R (SEQ ID NO:856) primers was measured by real time PCR. In parallel the expression of four housekeeping genes PBGD (GenBank Accession No. BC019323 (SEQ ID NO:926); amplican-PBGD-amplicon (SEQ ID NO:929)), HPRT1 (GenBank Accession No. NM.sub.--000194 (SEQ ID NO:930); amplicon-HPRT 1-amplicon (SEQ ID NO:933)), and SDHA (GenBank Accession No. NM.sub.--004168. (SEQ ID NO:922); amplicon-SDHA-amplicon (SEQ ID NO:925 ), G6PD (GenBank Accession No. NM.sub.--000402 (SEQ ID NO:918); G6PD-amplicon (SEQ ID NO:921)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67 Table 1, "Tissue samples in testing panel"), to obtain a value of fold up-regulation for each sample relative to median of the normal PM samples.

Figure 19:
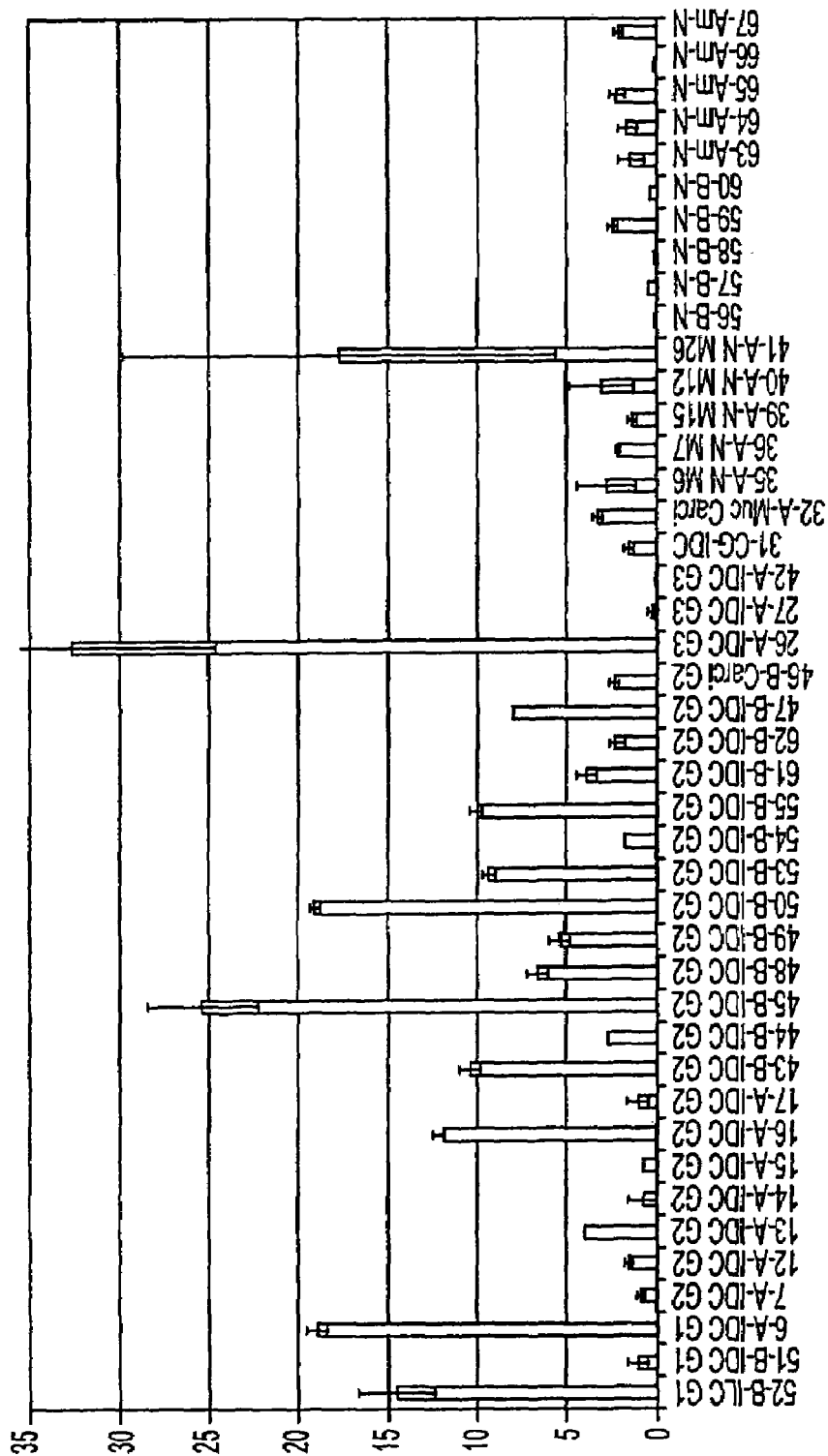
FIG. 19 is a histogram showing the expression of GRP_HUMAN—gastrin-releasing peptide (HUMGRP5E) transcripts, which are detectable by amplicon, as depicted insequence name HUMGRP5Ejunc3-7 (SEQ ID NO:857) in normal and cancerous breast tissues.

FIG. 19 is a histogram showing over expression of the above-indicated GRP_HUMAN-gastrin-releasing peptide transcripts in cancerous breast samples relative to the normal samples. Values represent the average of duplicate experiments. Error bars indicate the minimal and maximal values obtained.

As is evident from FIG. 19, the expression of GRP_HUMAN-gastrin-releasing peptide transcripts detectable by the above amplicon(s) in cancer samples was significantly higher than in the non-cancerous samples (Sample Nos. 56-60, 63-67, Table 1 "Tissue samples in testing panel"). Notably an over-expression of at least 5 fold was found in 12 out of 28 adenocarcinoma samples.

Statistical analysis was applied to verify the significance of these results, as described below.

The P value for the difference in the expression levels of GRP_HUMAN-gastrin-releasing peptide transcripts detectable by the above amplicon(s) in breast cancer samples versus the normal tissue samples was determined by T test as 7.22E-04.

Threshold of 5 fold over expression was found to differentiate between cancer and normal samples with P value of 1.12E-02 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: HUMGRP5Ejunc3-7F forward primer (SEQ ID NO:855); and HUMGRP5Ejunc3-7R reverse primer (SEQ ID NO:856).

The present invention also preferably encompasses any amplicon obtained through the use of any suitable primer pair; for example, for the above experiment, the following amplicon was obtained as a non-limiting illustrative example only of a suitable amplicon: TABLE-US-00350 HUMGRP5Ejunc3-7. (SEQ ID NO:857) HUMGRP5Ejunc3-7F (SEQ ID NO:855) ACCAGCCAC-CTCMCCCA HUMGRP5Ejunc3-7R (SEQ ID NO:856) CTGGAGCAGAGAGTCTTTGCCT HUMGRP5Ejunc3-7 (SEQ ID NO:857) ACCAGCCACCTCAACCCAAGGC-CCTGGGCMTCAGCAGCCTTCGTGGGAT TCAGAG-GATAGCAGCAACTTCAAAGATGTAGGT-TCAAAAGGCAAAGACTC TCTGCTCCAG Expression of GRP_HUMAN-Gastrin-Releasing Peptide (HUMGRP5E) Transcripts, which are Detectable by Amplicon, as Depicted in Sequence Name HUMGRP5Ejunc3-7 (SEQ ID NO:857) in Different Normal Tissues Expression of GRP_HUMAN-gastrin-releasing peptide transcripts detectable by or according to HUMGRP5E junc3-7 amplicon(s) and HUMGRP5E junc3-7F and HUMGRP5E junc3-7R was measured by real time PCR. In parallel the expression of four housekeeping genes—RPL19 (GenBank Accession No. NM.sub.--000981 (SEQ ID NO:934); RPL19 amplicon (SEQ ID NO:937 ), TATA box (GenBank Accession No. NM.sub.--003194 (SEQ ID NO:938); TATAamplicon (SEQ ID NO:941)), UBC (GenBank Accession No. BC000449 (SEQ ID NO:942); amplican-Ubiquitin-amplicon (SEQ ID NO:945)) and SDHA (GenBank Accession No. NM.sub.--004168 (SEQ ID NO:922); amplican-SDHA-amplicon (SEQ ID NO:925)) was measured similarly. For each RT sample, the expression of the above amplicon was normalized to the geometric mean of the quantities of the housekeeping genes. The normalized quantity of each RT sample was then divided by the median of the quantities of the breast samples (Sample Nos. 33-35 above, Table 2, "Tissue samples in normal panel"), to obtain a value of relative expression of each sample relative to median of the breast samples. Primers and amplicon are as above.

Figure 20:
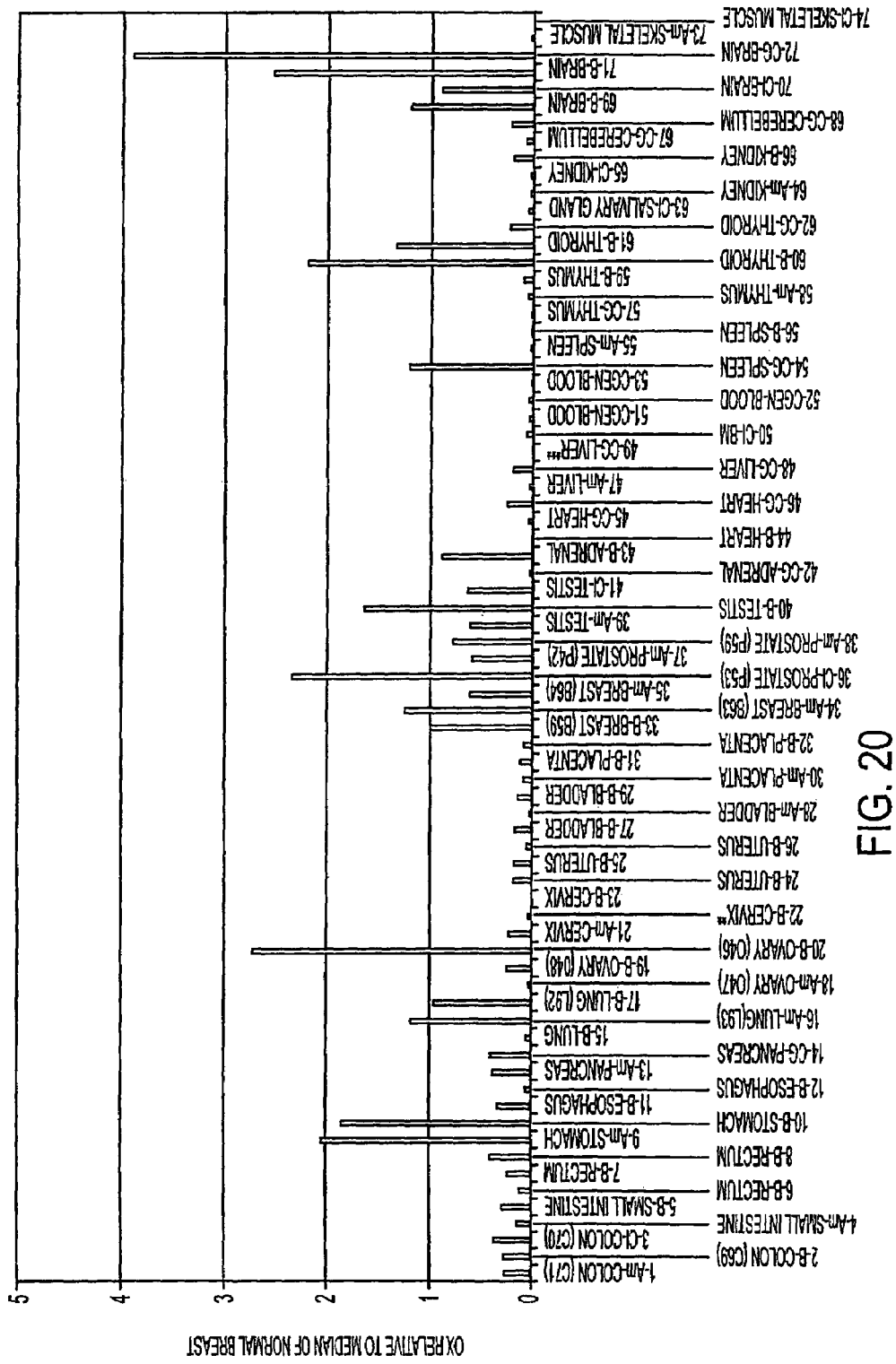
FIG. 20 is a histogram showing the expression of GRP_HUMAN—gastrin-releasing peptide (HUMGRP5E) transcripts, which are detectable by amplicon, as depicted in sequence name HUMGRP5Ejunc3-7 (SEQ ID NO:857), in different normal tissues.

The results are presented in FIG. 20, demonstrating the expression of GRP_HUMAN-gastrin-releasing peptide (HUMGRP5E) transcripts, which are detectable by amplicon, as depicted in sequence name HUMGRP5Ejunc3-7 (SEQ ID NO:857), in different normal tissues.

Description for Cluster AA155578

Cluster AA155578 features 4 transcript(s) and 15 segment(s) of interest, the names for which are given in Tables 1 and 2, respectively, the sequences themselves are given at the end of the application. The selected protein variants are given in table 3. TABLE-US-00351 TABLE 1 Transcripts of interest Transcript Name Sequence ID No. AA155578_PEA__1_T10 158 AA155578_PEA__1_T12 159AA155578_PEA__1_T13 160AA155578_PEA__1_T8 161

TABLE-US-00352 TABLE 2 Segments of interest Segment Name Sequence ID No. AA155578_PEA__1_node__11 162AA155578_PEA__1_node__12 163 AA155578_PEA__1_node__14 164AA155578_PEA__1_node__19 165 AA155578_PEA__1_node__21 166 AA155578_PEA__1_node__23 167 AA155578_PEA__1_node__24 168 AA155578_PEA__1_node__25 169 AA155578_PEA__1_node__4 170 AA155578_PEA__1_node__7 171 AA155578$_{PEA}$__1_node__15 172 AA155578_PEA__1_node__18 173AA155578_PEA__1_node__22 174AA155578_PEA__1_node__6 175 AA155578_PEA__1_node__8 176

TABLE-US-00353 TABLE 3 Proteins of interest Protein Name Sequence ID No. AA155578_PEA__1_P4 178 AA155578_PEA__1_P6 179 AA155578_PEA__1_P8 180 AA155578_PEA__1_P9 181

These sequences are variants of the known protein Kallikrein 10 precursor (SEQ ID NO:177) (SwissProt accession identifier KLKA_HUMAN; known also according to the synonyms EC 3.4.21.-; Protease serine-like 1; Normal epithelial cell-specific 1), SEQ ID NO: 177, referred to herein as the previously known protein.

Protein Kallikrein 10 precursor (SEQ ID NO:177) is known or believed to have the following function(s): Has a tumor-suppressor role for NES1 in breast and prostate cancer.

The sequence for protein Kallikrein 10 precursor (SEQ ID NO:177) is given at the end of the application, as "Kallikrein 10 precursor (SEQ ID NO:177) amino acid sequence". Known polymorphisms for this sequence are as shown in Table 4. TABLE-US-00354 TABLE 4 Amino acid mutations for Known Protein SNP position(s) on amino acid sequence Comment 50 A→S 149 P→L Protein Kallikrein 10 precursor (SEQ ID NO:177) localization is believed to be Secreted (Probable).

The following GO Annotation(s) apply to the previously known protein. The following annotation(s) were found: proteolysis and peptidolysis, which are annotation(s) related to Biological Process; chymotrypsin; trypsin; serine-type peptidase; hydrolase, which are annotation(s) related to Molecular Function; and extracellular, which are annotation(s) related to Cellular Component.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster AA155578 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 21 refer to weighted expression of ESTs in each category, as "parts per million" (ratio of the expression of ESTs for a particular cluster to the expression of all ESTs in that category, according to parts per million).

Figure 21:
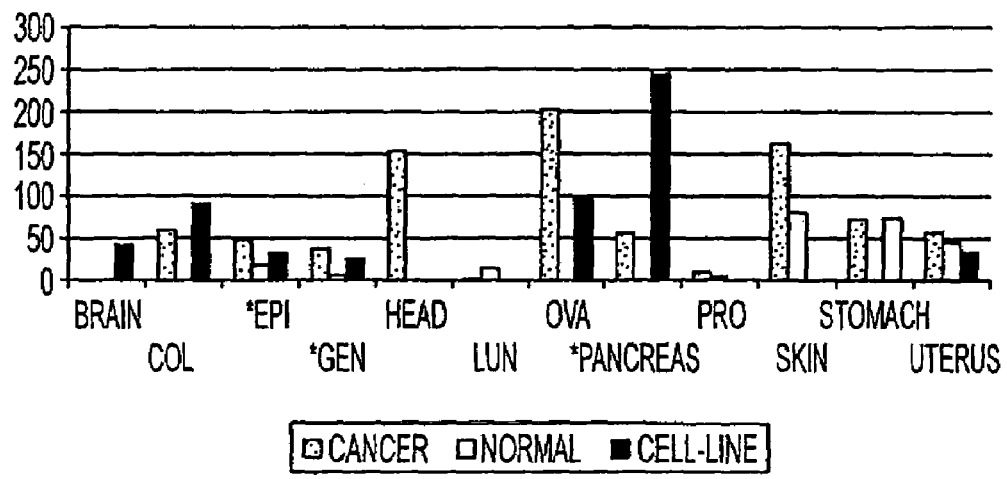
FIG. 21 is a histogram showing Cancer and cell-line vs. normal tissue expression for Cluster AA155578, demonstrating overexpression in epithelial malignant tumors, a mixture of malignant tumors from different tissues and pancreas carcinoma.

Overall, the following results were obtained as shown with regard to the histograms in FIG. 21 and Table 5. This cluster is overexpressed (at least at a minimum level) in the following pathological conditions: epithelial malignant tumors, a mixture of malignant tumors from different tissues and pancreas carcinoma. TABLE-US-00355 TABLE 5 Normal tissue distribution Name of Tissue Number Brain 0 Colon 0 epithelial 17 general 5 head and neck 0 Lung 14 Ovary 0 pancreas 0 prostate 4 Skin 80 stomach 0 Uterus 45

TABLE-US-00356 TABLE 6 P values and ratios for expression in cancerous tissue Name of Tissue P1 P2 SP1 R3 SP2 R4 Brain 1 3.7e-01 1 1.0 3.5e-02 5.1 Colon 6.3e-02 2.9e-02 2.4e-01 2.9 1.6e-01 3.2 epithelial 4.9e-03 2.0e-02 7.5e-04 2.1 2.3e-03 1.9 general 7.8e-07 7.2e-06 3.8e-10 4.8 2.6e-10 4.4 head and neck 1.0e-02 3.5e-02 4.6e-01 2.5 7.5e-01 1.4 Lung 8.5e-01 9.2e-01 1 0.5 1 0.5 Ovary 2.2e-01 1.6e-01 1.0e-02 3.3 1.8e-02 3.4 pancreas 3.3e-01 6.9e-02 3.2e-02 3.7 2.4e-04 10.0 prostate 8.3e-01 8.7e-01 6.7e-01 1.2 7.5e-01 1.1 Skin 6.0e-01 8.1e-01 3.2e-01 1.9 1 0.3 stomach 3.0e-01 2.7e-01 2.5e-01 3.0 1.6e-01 2.3 Uterus 1.8e-01 3.2e-01 5.6e-01 0.8 6.8e-01 0.8

As noted above, cluster AA155578 features 4 transcript(s), which were listed in Table 1 above. These transcript(s) encode for protein(s) which are variant(s) of protein Kallikrein 10 precursor (SEQ ID NO:177). A description of each variant protein according to the present invention is now provided.

Variant protein AA155578_PEA.sub.--1_P4 (SEQ ID NO:178) according to the present invention has an amino acid sequence as given at the end of the application; it is encoded by transcript(s) AA155578_PEA.sub.--1_T10 (SEQ ID NO:158). An alignment is given to the known protein (Kallikrein 10 precursor (SEQ ID NO:177) ) at the end of the application. One or more alignments to one or more previously published protein sequences are given at the end of the application. A brief description of the relationship of the variant protein according to the present invention to each such aligned protein is as follows:

Comparison report between AA155578_PEA.sub.--1_P4 (SEQ ID NO:178) and KLKA_HUMAN (SEQ ID NO:177):

1. An isolated chimeric polypeptide encoding for AA155578_PEA.sub.--1_P4 (SEQ ID NO:178), comprising a first amino acid sequence being at least 90% homologous to MRAPHLHLSAASGARALAKLLPLLMAQL-WMEMLLPQNDTRLDPEAYGAPCARGSQ PWQVS-LFNGLSFHCAGVLVDQSWVLTMHCGNK-PLWARVGDDHLLLLQGEQLRRTT RSWHPKYHQGSGPILPRRTDEHDLMLLKLARP corresponding to amino acids 1-146 of KLKA_HUMAN (SEQ ID NO:177), which also corresponds to amino acids 1-146 of AA155578_PEA.sub.--1_P4 (SEQ ID NO:178), and a second amino acid sequence being at least 90% homologous to YNKGLTCSSITILSPKECEVFYPGWT-NNMICAGLDRGQDPCQSDSGGPLVCDETLQGIL SWGVYPCGSAQHPAVYTQICKYMSWINKVIRSN corresponding to amino acids 184-276 of KLKA_HUMAN (SEQ ID NO:177), which also corresponds to amino acids 147-239 of AA155578_PEA.sub.--1_P4 (SEQ ID NO:178), wherein said first and second amino acid sequences are contiguous and in a sequential order.

2. An isolated chimeric polypeptide encoding for an edge portion of AA155578_PEA.sub.--1_P4 (SEQ ID NO:178), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PY, having a structure as follows: a sequence starting from any of amino acid numbers 146-x to 146; and ending at any of amino acid numbers 147+((n−2)-x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AA155578_PEA.sub.--1_P4 (SEQ ID NO:178) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein AA155578_PEA.sub.--1_P4 (SEQ ID NO:178) sequence provides support for the deduced sequence of this variant protein according to the present invention). TABLE-US-00357 TABLE 7 Amino acid mutations SNP position(s) on amino acid Alternative sequence amino acid(s) Previously known SNP? 123 Q→R No 145 R→G No 145 R→M Yes 168 Y→No 19 K→No 194G→No43 L→S No50A→S Yes60Q→R No Variant protein AA155578_PEA.sub.--1_P4 (SEQ ID NO:178) is encoded by the following transcript(s): AA155578_PEA.sub.--1_T10 (SEQ ID NO:158), for which the sequence(s) is/are given at the end of the application. The coding portion of transcript Ml 55578_PEA.sub.--1_T10 SEQ ID NO:158) is shown in bold; this coding portion starts at position 148 and ends at position 864. The transcript also has the following SNPs as listed in Table 8 (given according to their position on the nucleotide sequence, with the alternative nucleic acid listed; the last column indicates whether the SNP is known or not; the presence of known SNPs in variant protein AA155578_PEA.sub.--1_P4 (SEQ ID NO:178) sequence provides support for the deduced sequence variant protein according to the present invention). TABLE-US-00358 TABLE 8 Nucleic acid SNPs SNP position on nucleotide Alternative sequence nucleic acid Previously known SNP? 19 C→G Yes 88 G→No 570 A→G Yes 580 A→G No 581 G→T Yes 651 C→No 729 C→No 733 C→T No 875 G→A No 906 C→A No 907 C→A No 952 C→A No 204 G→No 953 C→A No 994 C→AYes 1125 C→T Yes 1192 C→T Yes 1330 G→No 1330 G→T Yes 275 T→C No 295 G→T Yes 326 A→G No 444 C→T Yes 465 C→A Yes 483 G→C Yes 515 A→G No Variant protein AA155578_PEA.sub.--1_P6 (SEQ ID NO:179) according to the present invention has an amino acid sequence as given at the end of the application; it is encoded by transcript(s) AA155578_PEA.sub.--1_T12 (SEQ ID NO:159). An alignment is given to the known protein (Kallikrein 10 precursor (SEQ ID NO:177) ) at the end of the application. One or more alignments to one or more previously published protein sequences are given at the end of the application. A brief description of the relationship of the variant protein according to the present invention to each such aligned protein is as follows:

Comparison report between AA155578_PEA.sub.--1_P6 (SEQ ID NO:179) and KLKA_HUMAN (SEQ ID NO:177):

1. An isolated chimeric polypeptide encoding for AA155578_PEA.sub.--1_P6 (SEQ ID NO:179), comprising a first amino acid sequence being at least 90% homologous to MRAPHLHLSAASGARALAKLLPLLMAQLW corresponding to amino acids 1-29 of KLKA_HUMAN (SEQ ID NO:177), which also corresponds to amino acids 1-29 of AA155578_PEA.sub.--1_P6 (SEQ ID NO:179), and a second amino acid sequence being at least 90% homologous to VKYNKGLTCSSITILSPKECEVFYPGWT-NNMICAGLDRGQDPCQSDSGGPLVCDETLQ GILSWGVYPCGSAQHPAVYTQICKYMSWINKVIRSN corresponding to amino acids 182-276 of KLKA_HUMAN (SEQ ID NO:177), which also corresponds to amino acids 30-124 of AA155578_PEA.sub.--1_P6 (SEQ ID NO:179), wherein said first and second amino acid sequences are contiguous and in a sequential order.

2. An isolated chimeric polypeptide encoding for an edge portion of AA155578_PEA.sub.--1_P6 (SEQ ID NO:179), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WV, having a structure as follows: a sequence starting from any of amino acid numbers 29-x to 29; and ending at any of amino acid numbers 30+((n−2)-x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AA155578_PEA.sub.--1_P6 (SEQ ID NO:179) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein AA155578_PEA.sub.--1_P6 (SEQ ID NO:179) sequence provides support for the deduced sequence of this variant protein according to the present invention). TABLE-US-00359 TABLE 9 Amino acid mutations SNP position(s) on amino acid Alternative sequence amino acid(s) Previously known SNP? 19 K→No 53 Y→No 79 G→No Variant protein AA155578_PEA.sub.--1_P6 (SEQ ID NO:179) is encoded by the following transcript(s): AA155578_PEA.sub.--1_T12 (SEQ ID NO:159), for which the sequence(s) is/are given at the end of the application. The coding portion of transcript AA155578_PEA.sub.--1_T12 (SEQ ID NO:159) is shown in bold; this coding portion starts at position 148 and ends at position 519. The transcript also has the following SNPs as listed in Table 10 (given according to their position on the nucleotide sequence, with the alternative nucleic acid listed; the last column indicates whether the SNP is known or not; the presence of known SNPs in variant protein AA155578_PEA.sub.--1_P6 (SEQ ID NO:179) sequence provides support for the deduced sequence of this variant protein according to the present invention). TABLE-US-00360 TABLE 10 Nucleic acid SNPs SNP position on nucleotide Alternative sequence nucleic acid Previously known SNP? 19 C→G Yes 88 G→No 608 C→A No 649 C→A Yes 780 C→T Yes 847 C→T Yes 985 G→No 985.G→T Yes 204 G→No 306 C→No 384 C→No 388 C→T No 530 G→A No 561 C→A No 562 C→A No 607 C→A No Variant protein AA155578_PEA.sub.--1_P8 (SEQ ID NO:180) according to the present invention has an amino acid sequence as given at the end of the application; it is encoded by transcript(s) AA155578_PEA.sub.--1_T8 (SEQ ID NO:161). An alignment is given to the known protein (Kallikrein 10 precursor (SEQ ID NO:177) ) at the end of the application. One or more alignments to one or more previously published protein sequences are given at the end of the application. A brief description of the relationship of the variant protein according to the present invention to each such aligned protein is as follows:

Comparison report between AA155578_PEA.sub.--1_P8 (SEQ ID NO:180) and KLKA_HUMAN (SEQ ID NO:177):

1. An isolated chimeric polypeptide encoding for AA155578_PEA.sub.--1_P8 (SEQ ID NO:180), comprising a first amino acid sequence being at least 90% homologous to MRAPHLHLSAASGARALAKLLPLLMAQLW corresponding to amino acids 1-29 of KLKA_HUMAN (SEQ ID NO:177, which also corresponds to amino acids 1-29 of AA155578_PEA.sub.--1_P8 (SEQ ID NO:180), and a second amino acid sequence being at least 70%, optionally at least 80%, preferably at least 85%, more preferably at least 90% and most preferably at least 95% homologous to a polypeptide having the sequence GHCGLE (SEQ ID NO:1018) corresponding to amino acids 30-35 of AA155578_PEA.sub.--1_P8 (SEQ ID NO:180), wherein said first and second amino acid sequences are contiguous and in a sequential order.

2. An isolated polypeptide encoding for a tail of AA155578_PEA.sub.--1_P8 (SEQ ID NO:180), comprising a polypeptide being at least 70%, optionally at least about 80%, preferably at least about 85%, more preferably at least about 90% and most preferably at least about 95% homologous to the sequence GHCGLE (SEQ ID NO:1018) in AA155578_PEA.sub.--1_P8 (SEQ ID NO:180).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AA155578_PEA.sub.--1_P8 (SEQ ID NO:180) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein AA155578_PEA.sub.--1_P8 (SEQ ID NO:180) sequence provides support for the deduced sequence of this variant protein according to the present invention). TABLE-US-00361 TABLE 11 Amino acid mutations SNP position(s) on amino acid Alternative sequence amino acid(s) Previously known SNP? 19 K→No Variant protein AA155578_PEA.sub.--1_P8 (SEQ ID NO:180) is encoded by the following transcript(s): AA155578_PEA.sub.--1_T8 (SEQ ID NO:161), for which the sequence(s) is/are given at the end of the application. The coding portion of transcript AA155578_PEA.sub.--1_T8 (SEQ ID NO:161) is shown in bold; this coding portion starts at position 285 and ends at position 389. The transcript also has the following SNPs as listed in Table 12 (given according to their position on the nucleotide sequence, with the alternative nucleic acid listed; the last column indicates whether the SNP is known or not; the presence of known SNPs in variant protein AA155578_PEA.sub.--1_P8 (SEQ ID NO:180) sequence provides support for the deduced sequence of this variant protein according to the present invention). TABLE-US-00362 TABLE 12 Nucleic acid SNPs SNP position on nucleotide Alternative sequence nucleic acid Previously known SNP? 341 G→No 400 C→T Yes 718 C→No 796 C→No 800 C→T No 942 G→A No 973 C→A No 974 C→A No 1019 C→A No 1020 C→A No 1061 C→A Yes 1192 C→T Yes 421 C→A Yes 1259 C→T Yes 1397 G→No 1397 G→T Yes 439 G→C Yes 471 A→G No 526 A→G Yes 536 A→G No 537 G→T Yes 549 C→T Yes 587 T→C No Variant protein AA155578_PEA.sub.--1_P9 (SEQ ID NO:181) according to the present invention has an amino acid sequence as given at the end of the application; it is encoded by transcript(s) AA155578_PEA.sub.--1_T13 (SEQ ID NO:160). An alignment is given to the known protein (Kallikrein 10 precursor (SEQ ID NO:177)) at the end of the application. One or more alignments to one or more previously published protein sequences are given at the end of the application. A brief description of the relationship of the variant protein according to the present invention to each such aligned protein is as follows:

Comparison report between AA155578_PEA.sub.--1_P9 (SEQ ID NO:181) and KLKA_HUMAN (SEQ ID NO:177):

1. An isolated chimeric polypeptide encoding for AA155578_PEA.sub.--1_P9 (SEQ ID NO:181), comprising a first amino acid sequence being at least 90% homologous to MRAPHLHLSMSGARALAKLLPLLMAQLW-MEMLLPQNDTRLDPEAYGAPCARGSQ PWQVS-LFNGLSFHCAGVLVDQSWVLTMHCGNK corresponding to amino acids 1-90 of KLKA_HUMAN (SEQ ID NO:177), which also corresponds to amino acids 1-90 of AA155578_PEA.sub.--1_P9 (SEQ ID NO:181).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AA155578_PEA.sub.--1_P9 (SEQ ID NO:181) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein AA155578_PEA.sub.--1_P9 (SEQ ID NO:181) sequence provides support for the deduced sequence of this variant protein according to the present invention). TABLE-US-00363 TABLE 13 Amino acid mutations SNP position(s) on amino acid Alternative sequence amino acid(s) Previously known SNP? 19 K→No 43 L→S No 50 A→S Yes 60 Q→R No Variant protein A155578_PEA.sub.--1_P9 (SEQ ID NO:181) is encoded by the following transcript(s): AA155578_PEA.sub.--1_T13 (SEQ ID NO:160), for which the sequence(s) is/are given at the end of the application. The coding portion of transcript AA155578_PEA.sub.--1_T13 (SEQ ID NO:160) is shown in bold; this coding portion starts at position 148 and ends at position 417. The transcript also has the following SNPs as listed in Table 14 (given according to their position on the nucleotide sequence, with the alternative nucleic acid listed; the last column indicates whether the SNP is known or not; the presence of known SNPs in variant protein AA155578_PEA.sub.--1_P9 (SEQ ID NO:181) sequence provides support for the deduced sequence of this variant protein according to the present invention). TABLE-US-00364 TABLE 14 Nucleic acid SNPs SNP position on nucleotide Alternative sequence nucleic acid Previously known SNP? 19 C→G Yes 88 G→No 204 G→No 275 T→C No 295 G→T Yes 326 A→G No 559 G→C Yes 560 C→G Yes 582 A→G Yes 919 T→A Yes As noted above, cluster AA155578 features 15 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster AA155578_PEA.sub.--1_node.sub.--11 (SEQ ID NO:162) according to the present invention is supported by 34 libraries. The number of libraries was determined as previously described. This segment can be found in the following transcript(s): AA55578_PEA.sub.--1_T10 (SEQ ID NO:158) and AA155578_PEA.sub.--1_T13 (SEQ ID NO:160). Table 15 below describes the starting and ending position of this segment on each transcript. TABLE-US-00365 TABLE 15 Segment location on transcripts Segment starting Segment ending Transcript name position position AA155578_PEA__1_T10 236 416 (SEQ ID NO: 158) AA155578_PEA__1_T13 236 416 (SEQ ID NO: 160)

Segment cluster AA155578_PEA.sub.--1_node.sub.--12 (SEQ ID NO:163) according to the present invention is supported by 3 libraries. The number of libraries was determined as previously described. This segment can be found in the following transcript(s): AA155578_PEA.sub.--1_T13 (SEQ ID NO:160). Table 16 below describes the starting and ending position of this segment on each transcript. TABLE-US-00366 TABLE 16 Segment location on transcripts Segment starting Segment ending Transcript name position position AA155578_PEA__1_T13 417 935 (SEQ ID NO: 160)

Segment cluster AA155578_PEA.sub.--1_node.sub.--14 (SEQ ID NO:164) according to the present invention is supported by 31 libraries. The number of libraries was determined as previously described. This segment can be found in the following transcript(s): AA155578_PEA.sub.--1_T10 (SEQ ID NO:158) and AA155578_PEA.sub.--1_T8 (SEQ ID NO:161). Table 17 below describes the starting and ending position of this segment on each transcript. TABLE-US-00367 TABLE 17 Segment location on transcripts Segment Transcript name starting position Segment ending position AA155578_PEA__1_T10 417 585 (SEQ ID NO: 158) AA155578_PEA__1_T8 373 541 (SEQ ID NO: 161)

Segment cluster AA155578_PEA.sub.--1_node.sub.--19 (SEQ ID NO:165) according to the present invention is supported by 45 libraries. The number of libraries was determined as previously described. This segment can be found in the following transcript(s): AA155578_PEA.sub.--1_T10 (SEQ ID NO:158), AA155578_PEA.sub.--1_T12 (SEQ ID NO:159) and AA155578_PEA.sub.--1_T8 (SEQ ID NO:161). Table 18 below describes the starting and ending position of this segment on each transcript. TABLE-US-00368 TABLE 18 Segment location on transcripts Segment Transcript name starting position Segment ending position AA155578_PEA__1_T10 586 714 (SEQ ID NO: 158) AA155578_PEA__1_T12 241 369 (SEQ ID NO: 159) AA155578_PEA__1_T8 653 781 (SEQ ID NO: 161)

Segment cluster AA155578_PEA.sub.--1_node.sub.--21 (SEQ ID NO:166) according to the present invention is supported by 53 libraries. The number of libraries was determined as previously described. This segment can be found in the following transcript(s): AA155578_PEA.sub.--1_T10 (SEQ ID NO:158), AA155578_PEA.sub.--1_T12 (SEQ ID NO:159) and AA155578_PEA.sub.--1_T8 (SEQ ID NO:161). Table 19 below describes the starting and ending position of this segment on each transcript. TABLE-US-00369 TABLE 19 Segment location on transcripts Segment Transcript name starting position Segment ending position AA155578_PEA__1_T10 715 863 (SEQ ID NO: 158) AA155578_PEA__1_T12 370 518 (SEQ ID NO: 159) AA155578_PEA__1_T8 782 930 (SEQ ID NO: 161)

Segment cluster AA155578_PEA.sub.--1_node.sub.--23 (SEQ ID NO:167) according to the present invention is supported by 71 libraries. The number of libraries was determined as previously described. This segment can be found in the following transcript(s): AA155578_PEA.sub.--1_T10 (SEQ ID NO:158), AA155578_PEA.sub.--1_T12 (SEQ ID NO:159) and AA155578_PEA.sub.--1_T8 (SEQ ID NO:161). Table 20 below describes the starting and ending position of this segment on each transcript. TABLE-US-00370 TABLE 20 Segment location on transcripts Segment Transcript name starting position Segment ending position AA155578_PEA__1_T10 887 1063 (SEQ ID NO: 158) AA155578_PEA__1_T12 542 718 (SEQ ID NO: 159) AA155578_PEA__1_T8 954 1130 (SEQ ID NO: 161)

Segment cluster AA155578_PEA.sub.--1_node.sub.--24 (SEQ ID NO:168) according to the present invention is supported by 52 libraries. The number of libraries was determined as previously described. This segment can be found in the following transcript(s): AA155578_PEA.sub.--1_T10 (SEQ ID NO: 158), AA155578_PEA.sub.--1_T12 (SEQ ID NO: 159) and AA155578_PEA.sub.--1_T8 (SEQ ID NO:161). Table 21 below describes the starting and ending position of this segment on each transcript. TABLE-US-00371 TABLE 21 Segment location on transcripts Segment Transcript name starting position Segment ending position AA155578_PEA__1_T10 1064 1184 (SEQ ID NO: 158) AA155578_PEA__1_T12 719 839 (SEQ ID NO: 159) AA155578_PEA__1_T8 1131 1251 (SEQ ID NO: 161)

Segment cluster AA155578_PEA.sub.--1_node.sub.--25 (SEQ ID NO:169) according to the present invention is supported by 53 libraries. The number of libraries was determined as previously described. This segment can be found in the following transcript(s): AA155578_PEA.sub.--1_T10 (SEQ ID NO:158) AA155578_PEA.sub.--1_T12 (SEQ ID NO:159) and AA155578_PEA.sub.--1_T8 (SEQ ID NO:161). Table 22 below describes the starting and ending position of this segment on each transcript. TABLE-US-00372 TABLE 22 Segment location on transcripts Segment Transcript name starting position Segment ending position AA155578_PEA__1_T10 1185 1397 (SEQ ID NO: 158) AA155578_PEA__1_T12 840 1052 (SEQ ID NO: 159) AA155578_PEA__1_T8 1252 1464 (SEQ ID NO: 161)

Segment cluster AA155578_PEA.sub.--1_node.sub.--4 (SEQ ID NO:170) according to the present invention is supported by 21 libraries. The number of libraries was determined as previously described. This segment can be found in the following transcript(s): AA155578_PEA.sub.--1_T10 (SEQ ID NO:158) AA155578_PEA.sub.--1_T12 (SEQ ID NO:159) and AA155578_PEA.sub.--1_T13 (SEQ ID NO:160). Table 23 below describes the starting and ending position of this segment on each transcript. TABLE-US-00373 TABLE 23 Segment location on transcripts Segment Transcript name starting position Segment ending position AA155578_PEA__1_T10 1 138 (SEQ ID NO: 158) AA155578_PEA__1_T12 1 138 (SEQ ID NO: 159) AA155578_PEA__1_T13 1 138 (SEQ ID NO: 160)

Segment cluster AA155578_PEA.sub.--1_node.sub.--7 (SEQ ID NO:171) according to the present invention is supported by 3 libraries. The number of libraries was determined as previously described. This segment can be found in the following transcript(s): AA155578_PEA.sub.--1_T8 (SEQ ID NO:161). Table 24 below describes the starting and ending position of this segment on each transcript. TABLE-US-00374 TABLE 24 Segment location on transcripts Segment Transcript name starting position Segment ending position AA155578_PEA__1_T8 92 275 (SEQ ID NO: 161)

According to an optional embodiment of the present invention, short segments related to the above cluster are also provided. These segments are up to about 120 bp in length, and so are included in a separate description.

Segment cluster AA155578_PEA.sub.--1_node.sub.--15 (SEQ ID NO:172) according to the present invention is supported by 33 libraries. The number of libraries was determined as previously described. This segment can be found in the following transcript(s): AA155578_PEA.sub.--1_T8 (SEQ ID NO:161). Table 25 below describes the starting and ending position of this segment on each transcript. TABLE-US-00375 TABLE 25 Segment location on transcripts Segment Transcript name starting position Segment ending position AA155578_PEA__1_T8 542 647 (SEQ ID NO: 161)

Segment cluster AA155578_PEA.sub.--1_node.sub.--18 (SEQ ID NO: 173) according to the present invention can be found in the following transcript(s): AA155578_PEA.sub.--1_T12 (SEQ ID NO:159) and AA155578_PEA.sub.--1_T8 (SEQ ID NO:161). Table 26 below describes the starting and ending position of this segment on each transcript. TABLE-US-00376 TABLE 26 Segment location on transcripts Segment Transcript name starting position Segment ending position AA155578_PEA__1_T12 236 240 (SEQ ID NO: 159) AA155578_PEA__1_T8 648 652 (SEQ ID NO: 161)

Segment cluster AA155578_PEA.sub.--1_node.sub.--22 (SEQ ID NO:174) according to the present invention can be found in the following transcript(s): AA155578_PEA.sub.--

1_T10 (SEQ ID NO:158), AA155578_PEA.sub.--1_T12 (SEQ ID NO:159) and AA155578_PEA.sub.--1_T8 (SEQ ID NO:161). Table 27 below describes the starting and ending position of this segment on each transcript. TABLE-US-00377 TABLE 27 Segment location on transcripts Segment Transcript name starting position Segment ending position AA155578_PEA__1_T10 864 886 (SEQ ID NO: 158) AA155578_PEA__1_T12 519 541 (SEQ ID NO: 159) AA155578_PEA__1_T8 931 953 (SEQ ID NO: 161)

Segment cluster AA155578_PEA.sub.--1_node.sub.--6 (SEQ ID NO:175) according to the present invention is supported by 2 libraries. The number of libraries was determined as previously described. This segment can be found in the following transcript(s): AA155578_PEA.sub.--1_T8 (SEQ ID NO:161). Table 28 below describes the starting and ending position of this segment on each transcript. TABLE-US-00378 TABLE 28 Segment location on transcripts Segment Transcript name starting position Segment ending position AA155578_PEA__1_T8 1 91 (SEQ ID NO: 161)

Segment cluster AA155578_PEA.sub.--1_node.sub.--8 (SEQ ID NO:176) according to the present invention is supported by 26 libraries. The number of libraries was determined as previously described. This segment can be found in the following transcript(s): AA155578_PEA.sub.--1_T10 (SEQ ID NO:158), AA155578_PEA.sub.--1_T12 (SEQ ID NO:159), AA155578_PEA.sub.--1_T13 (SEQ ID NO:160) and AA155578_PEA.sub.--1_T8 (SEQ ID NO:161). Table 29 below describes the starting and ending position of this segment on each transcript. TABLE-US-00379 TABLE 29 Segment location on transcripts Segment Transcript name starting position Segment ending position AA155578_PEA__1_T10 139 235 (SEQ ID NO: 158) AA155578_PEA__1_T12 139 235 (SEQ ID NO: 159) AA155578_PEA__1_T13 139 235 (SEQ ID NO: 160) AA155578_PEA__1_T8 276 372 (SEQ ID NO: 161)

Variant protein alignment to the previously known protein:

Sequence name: /tmp/4gXdRV0C1z/cQ4LqHmh5A:KLKA_HUMAN (SEQ ID NO:177)

Sequence documentation:

Alignment of: AA155578_PEA.sub.--1_P4 (SEQ ID NO:178).times.KLKA_HUMAN (SEQ ID NO:177).

Alignment segment 1/1: TABLE-US-00380 Quality: 2283.00 Escore: 0 Matching length: 239 Total length: 276 Matching Percent 100.00 Matching Percent Identity: 100.00 Similarity: Total Percent Similarity: 86.59 Total Percent Identity: 86.59 Gaps: 1

```
Alignment: TABLE-US-00381 . . . 1
MRAPHLHLSAASGARALAKLLPLLMAQLWAAEEAALLPQNDTRLDPEAYGA  50
||||||||||||||||||||||||||||||||||||||||||||||||||
                                                    1
MRAPHLHLSAASGARALAKLLPLLMAQLWAAEEAALLPQNDTRLDPEAYGA  50 . . . 51

PCARGSQPWQVSLFNGLSFHCAGVLVDQSWVLTAAHCGNKPLWARVGDDH  100
|||||||||||||||||||||||||||||||||||||||||||||||||
                                                   51
PCARGSQPWQVSLFNGLSFHCAGVLVDQSWVLTAAHCGNKPLWARVGDDH  100 . . . 101

LLLLQGEQLRRTTRSVVHPKYHQGSGPILPRRTDEHDLMLLKLARP....  146
|||||||||||||||||||||||||||||||||||||||||||||
                                                   101
LLLLQGEQLRRTTRSVVHPKYHQGSGPILPRRTDEHDLMLLKLARPVVPG  150 . . . 147

.............................YNKGLTCSSITILSPKE    163
                              |||||||||||||||||
                                                  151
PRVRALQLPYRCAQPGDQCQVAGWGTTAARRVKYNKGLTCSSITILSPKE 200 . . . 164

CEVFYPGVVTNNMICAGLDRGQDPCQSDSGGPLVCDETLQGILSWGVYPC 213
|||||||||||||||||||||||||||||||||||||||||||||||||
                                                   201
CEVFYPGVVTNNMICAGLDRGQDPCQSDSGGPLVCDETLQGILSWGVYPC 250 . . . 214

GSAQHPAVYTQICKYMSWINKVIRSN                         239
||||||||||||||||||||||||||
                                                   251
GSAQHPAVYTQICKYMSWINKVIRSN                         276
```

Sequence name: /tmp/3VxcRS97HN/X9ncdxjYQx:KLKA_HUMAN (SEQ ID NO:177)

Sequence documentation:

Alignment of: AA155578_PEA.sub.--1_P6 (SEQ ID NO:179).times.KLKA_HUMAN (SEQ ID NO:177).

Alignment segment 1/1: TABLE-US-00382 Quality: 1140.00 Escore: 0 Matching length: 124 Total length: 276 Matching Percent 100.00 Matching Percent Identity: 100.00 Similarity: Total Percent Similarity: 44.93 Total Percent Identity: 44.93 Gaps: 1

```
Alignment: TABLE-US-00383 . . . 1
MRAPHLHLSAASGARALAKLLPLLMAQLW.....................  29
||||||||||||||||||||||||||||
                                                    1
MRAPHLHLSAASGARALAKLLPLLMAQLWAAEEAALLPQNDTRLDPEAYGA 50 . . . 29

..................................................  29 51
PCARGSQPWQVSLFNGLSFHCAGVLVDQSWVLTAAHCGNKPLWARVGDDH  100 . . . 29

..................................................  29 101
LLLLQGEQLRRTTRSVVHPKYHQGSGPILPRRTDEHDLMLLKLARPVVPG  150 . . . 30

.............................VKYNKGLTCSSITILSPKE   48
```

```
                    -continued
                   ||||||||||||||||||         151
PRVRALQLPYRCAQPGDQCQVAGWGTTAARRVKYNKGLTCSSITILSPKE  200 . . . 49

CEVFYPGWTNNMICAGLDRGQDPCQSDSGGPLVCDETLQGILSWGVYPC   98
||||||||||||||||||||||||||||||||||||||||||||||||  201
CEVFYPGWTNNMICAGLDRGQDPCQSDSGGPLVCDETLQGILSWGVYPC  250 . . . 99

GSAQHPAVYTQICKYMSWINKVIRSN                         124
||||||||||||||||||||||||||                         251
GSAQHPAVYTQICKYMSWINKVIRSN                         276
```

Sequence name: /tmp/LsSdTeu0qX/6luiCMKTi9:KL-KA_HUMAN (SEQ ID NO:177)
Sequence documentation:
Alignment of: AA155578_PEA.sub.--1_P8 (SEQ ID NO:180).times.KLKA_HUMAN (SEQ ID NO:177).
Alignment segment 1/1: TABLE-US-00384 Quality: 279.00 Escore: 0 Matching length: 29 Total length: 29 Matching Percent 100.00 Matching Percent Identity: 100.00 Similarity: Total Percent Similarity: 100.00 Total Percent Identity: 100.00 Gaps: 0

```
      Alignment: TABLE-US-00385 . . . 1
      MRAPHLHLSAASGARALAKLLPLLMAQLW          29
      ||||||||||||||||||||||||||||            1
      MRAPHLHLSAASGARALAKLLPLLMAQLW          29
```

Sequence name: /tmp/kcfKGMcF7s/YnKnMy8D1q:KL-KA_HUMAN (SEQ ID NO:177)
Sequence documentation:
Alignment of: AA155578_PEA.sub.--1_P9 (SEQ ID NO:181).times.KLKA_HUMAN (SEQ ID NO:177)
Alignment segment 1/1: TABLE-US-00386 Quality: 887.00 Escore: 0 Matching length: 90 Total length: 90 Matching Percent 100.00 Matching Percent Identity: 100.00 Similarity: Total Percent Similarity: 100.00 Total Percent Identity: 100.00 Gaps: 0

```
Alignment: TABLE-US-00387 . . . 1
MRAPHLHLSAASGARALAKLLPLLMAQLWAAEEAALLPQNDTRLDPEAYGA  50
||||||||||||||||||||||||||||||||||||||||||||||||||   1
MRAPHLHLSAASGARALAKLLPLLMAQLWAAEEAALLPQNDTRLDPEAYGA  50 . . . 51

PCARGSQPWQVSLFNGLSFHCAGVLVDQSWVLTAAHCGNK             90
|||||||||||||||||||||||||||||||||||||||              51
PCARGSQPWQVSLFNGLSFHCAGVLVDQSWVLTAAHCGNK             90
```

Description for Cluster HSENA78

Cluster HSENA78 features 1 transcript(s) and 7 segment(s) of interest, the names for which are given in Tables 1 and 2, respectively, the sequences themselves are given at the end of the application. The selected protein variants are given in table 3. TABLE-US-00388 TABLE 1 Transcripts of interest Transcript Name Sequence ID No. HSENA78_T5 182

TABLE-US-00389 TABLE 2 Segments of interest Segment Name Sequence ID No. HSENA78_node_0 183 HSENA78_node_2 184 HSENA78_node_6 185 HSENA78_node_9 186 HSENA78_node_3 187 HSENA78_node_4 188 HSENA78_node_8 189

TABLE-US-00390 TABLE 3 Proteins of interest Protein Name Sequence ID No. HSENA78_P2 191

These sequences are variants of the known protein Small inducible cytokine B5 precursor (SEQ ID NO:190) (SwissProt accession identifier SZ05_HUMAN; known also according to the synonyms CXCL5; Epithelial-derived neutrophil activating protein 78; Neutrophil-activating peptide ENA-78), SEQ ID NO: 190, referred to herein as the previously known protein.

Protein Small inducible cytokine B5 precursor (SEQ ID NO:190) is known or believed to have the following function(s): Involved in neutrophil activation. The sequence for protein Small inducible cytokine B5 precursor (SEQ ID NO:190) is given at the end of the application, as "Small inducible cytokine B5 precursor (SEQ ID NO:190) amino acid sequence". Protein Small inducible cytokine B5 precursor (SEQ ID NO:190) localization is believed to be Secreted.

The following GO Annotation(s) apply to the previously known protein. The following annotation(s) were found: chemotaxis; signal transduction; cell-cell signaling; positive control of cell proliferation, which are annotation(s) related to Biological Process; and chemokine, which are annotation(s) related to Molecular Function.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster HSENA78 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 22 refer to weighted expression of ESTs in each category, as "parts per million" (ratio of the expression of ESTs for a particular cluster to the expression of all ESTs in that category, according to parts per million).

Figure 22:
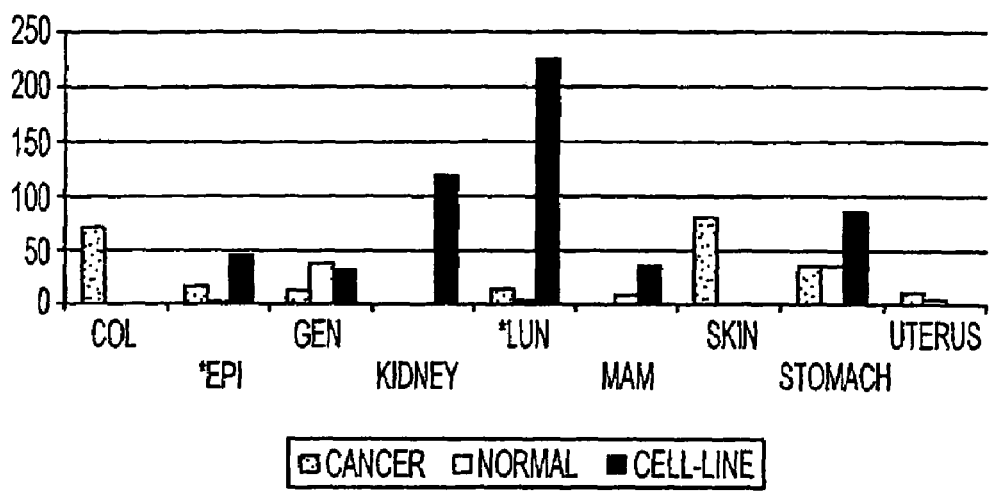
FIG. 22 is a histogram showing Cancer and cell-line vs. normal tissue expression for Cluster HSENA78, demonstrating overexpression in epithelial malignant tumors and lung malignant tumors.

Overall, the following results were obtained as shown with regard to the histograms in FIG. 22 and Table 4. This cluster is overexpressed (at least at a minimum level) in the following pathological conditions: epithelial malignant tumors and lung malignant tumors. TABLE-US-00391 TABLE 4 Normal tissue distribution Name of Tissue Number Colon 0 epithelial 2 general 38 kidney 0 Lung 3 Breast 8 Skin 0 stomach 36 Uterus 4

TABLE-US-00392 TABLE 5 P values and ratios for expression in cancerous tissue Name of Tissue P1 P2 SP1 R3 SP2 R4 colon 2.6e-01 3.3e-01 1.7e-01 2.7 2.7e-01 2.2 epithelial 2.5e-01 9.0e-02 3.2e-03 4.1 8.5e-07 5.5 general 8.4e-01 7.2e-01 1 0.3 1 0.4 kidney 1 7.2e-01 1 1.0 1.7e-01 1.9 lung 8.5e-01 4.8e-01 4.1e-01 1.9 4.0e-05 3.8 breast 9.5e-01 8.7e-

01 1 0.8 6.8e-01 1.2 skin 2.9e-01 4.7e-01 1.4e-01 7.0 6.4e-01 1.6 stomach 5.0e-01 4.3e-01 7.5e-01 1.0 4.3e-01 1.3 uterus 7.1e-01 8.5e-01 6.6e-01 1.3 8.0e-01 1.0

As noted above, cluster HSENA78 features 1 transcript(s), which were listed in Table 1 above. These transcript(s) encode for protein(s) which are variant(s) of protein Small inducible cytokine B5 precursor (SEQ ID NO:190). A description of each variant protein according to the present invention is now provided.

Variant protein HSENA78_P2 (SEQ ID NO:191) according to the present invention has an amino acid sequence as given at the end of the application; it is encoded by transcript(s) HSENA78_T5 (SEQ ID NO:182). An alignment is given to the known protein (Small inducible cytokine B5 precursor (SEQ ID NO:190)) at the end of the application. One or more alignments to one or more previously published protein sequences are given at the end of the application. A brief description of the relationship of the variant protein according to the present invention to each such aligned protein is as follows:

Comparison report between HSENA78_P2 (SEQ ID NO:191) and SZ05_HUMAN (SEQ ID NO:190):

1. An isolated chimeric polypeptide encoding for HSENA78_P2 (SEQ ID NO:191), comprising a first amino acid sequence being at least 90% homologous to MSLLSS-RAARVPGPSSSLCALLVLLLLLTQPGPI-ASAGPAAAVLRELRCVCLQTTQGVHP KMISNLQV-FAIGPQCSKVEVV corresponding to amino acids 1-81 of SZ05_HUMAN (SEQ ID NO:190), which also corresponds to amino acids 1-81 of HSENA78_P2 (SEQ ID NO:191).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSENA78_P2 (SEQ ID NO:191) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein HSENA78_P2 (SEQ ID NO:191) sequence provides support for the deduced sequence of this variant protein according to the present invention). TABLE-US-00393 TABLE 6 Amino acid mutations SNP position(s) on Alternative Previously known amino acid sequence amino acid(s) SNP? 80 V→No 81 V→No Variant protein HSENA78_P2 (SEQ ID NO:191) is encoded by the following transcript(s): HSENA78_T5 (SEQ ID NO:182), for which the sequence(s) is/are given at the end of the application. The coding portion of transcript HSENA78_T5 (SEQ ID NO:182) is shown in bold; this coding portion starts at position 149 and ends at position 391. The transcript also has the following SNPs as listed in Table 7 (given according to their position on the nucleotide sequence, with the alternative nucleic acid listed; the last column indicates whether the SNP is known or not; the presence of known SNPs in variant protein HSENA78_P2 (SEQ ID NO:191) sequence provides support for the deduced sequence of this variant protein according to the present invention). TABLE-US-00394 TABLE 7 Nucleic acid SNPs SNP position on nucleotide Alternative Previously known sequence nucleic acid SNP? 92 C→T Yes 144 C→T No 1151 A→T Yes 1389 T→C No 1867 C→G Yes 145 C→T No 181 C→T Yes 316 G→A Yes 388 G→No 390 T→No 605 T→No 972 C→T Yes 1105 A→G Yes As noted above, cluster HSENA78 features 7 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSENA78_node.sub.--0 (SEQ ID NO:183) according to the present invention is supported by 24 libraries. The number of libraries was determined as previously described. This segment can be found in the following transcript(s): HSENA78_T5 (SEQ ID NO:182). Table 8 below describes the starting and ending position of this segment on each transcript. TABLE-US-00395 TABLE 8 Segment location on transcripts Segment Segment Transcript name starting position ending position HSENA78_T5 1 257 (SEQ ID NO:182)

Segment cluster HSENA78_node.sub.--2 (SEQ ID NO:184) according to the present invention is supported by 22 libraries. The number of libraries was determined as previously described. This segment can be found in the following transcript(s): HSENA78_T5 (SEQ ID NO:182). Table 9 below describes the starting and ending position of this segment on each transcript. TABLE-US-00396 TABLE 9 Segment location on transcripts Segment Segment Transcript name starting position ending position HSENA78_T5 258 390 (SEQ ID NO:182)

Segment cluster HSENA78_node.sub.--6 (SEQ ID NO:185) according to the present invention is supported by 68 libraries. The number of libraries was determined as previously described. This segment can be found in the following transcript(s): HSENA78_T5 (SEQ ID NO:182). Table 10 below describes the starting and ending position of this segment on each transcript. TABLE-US-00397 TABLE 10 Segment location on transcripts Segment Segment Transcript name starting position ending position HSENA78_T5 585 2370 (SEQ ID NO:182)

Segment cluster HSENA78_node.sub.--9 (SEQ ID NO:186) according to the present invention is supported by 28 libraries. The number of libraries was determined as previously described. This segment can be found in the following transcript(s): HSENA78_T5 (SEQ ID NO:182). Table 11 below describes the starting and ending position of this segment on each transcript. TABLE-US-00398 TABLE 11 Segment location on transcripts Segment Segment Transcript name starting position ending position HSENA78_T5 2394 2546 (SEQ ID NO:182)

According to an optional embodiment of the present invention, short segments related to the above cluster are also provided. These segments are up to about 120 bp in length, and so are included in a separate description.

Segment cluster HSENA78_node.sub.--3 (SEQ ID NO:187) according to the present invention is supported by 1 libraries. The number of libraries was determined as previously described. This segment can be found in the following transcript(s): HSENA78_T5 (SEQ ID NO:182). Table 12 below describes the starting and ending position of this segment on each transcript. TABLE-US-00399 TABLE 12 Segment location on transcripts Segment Segment Transcript name starting position ending position HSENA78_T5 391 500 (SEQ ID NO:182)

Segment cluster HSENA78_node.sub.--4 (SEQ ID NO:188) according to the present invention is supported by 17 libraries. The number of libraries was determined as previously described. This segment can be found in the following transcript(s): HSENA78_T5 (SEQ ID NO: 182). Table 13 below describes the starting and ending position of this segment on each transcript. TABLE-US-00400 TABLE 13 Segment location on transcripts Segment Segment Transcript name starting position ending position HSENA78_T5 501 584 (SEQ ID NO:182)

Segment cluster HSENA78_node.sub.--8 (SEQ ID NO:189) according to the present invention can be found in the following transcript(s): HSENA78_T5 (SEQ ID NO:182). Table 14 below describes the starting and ending position of this segment on each transcript. TABLE-US-00401 TABLE 14 Segment location on transcripts Segment Segment Transcript name starting position ending position HSENA78_T5 2371 2393 (SEQ ID NO:182)

Microarray (chip) data is also available for this gene as follows. As described above with regard to the cluster itself, various oligonucleotides were tested for being differentially expressed in various disease conditions, particularly cancer. The following oligonucleotides were found to hit this segment (in relation to breast cancer), shown in Table 15. TABLE-US-00402 TABLE 15 Oligonucleotides related to this gene Overexpressed Oligonucleotide name in cancers Chip reference HSENA78_0_1_0 breast cancer Breast (SEQ ID NO:898)

Variant protein alignment to the previously known protein:
Sequence name: /tmp/5kiQY6MxWx/pLnTrxsCqk: SZ05_HUMAN (SEQ ID NO:190)
Sequence documentation:
Alignment of: HSENA78_P2 (SEQ ID NO:191).times. SZ05_HUMAN (SEQ ID NO:190).
Alignment segment 1/1: TABLE-US-00403 Quality: 767.00 Escore: 0 Matching length: 81 Total length: 81 Matching Percent 100.00 Matching Percent Identity: 100.00 Similarity: Total Percent Similarity: 100.00 Total Percent Identity: 100.00 Gaps: 0

TABLE-US-00407 TABLE 3 Proteins of interest Protein Name Sequence ID No. T94936_PEA_1_P2 206 T94936_PEA_1_P3 207

As noted above, cluster T94936 features 2 transcript(s), which were listed in Table 1 above. A description of each variant protein according to the present invention is now provided.

Variant protein T94936_PEA.sub.--1_P2 (SEQ ID NO:206) according to the present invention has an amino acid sequence as given at the end of the application; it is encoded by transcript(s) T94936_PEA.sub.--1_T1 (SEQ ID NO:192). One or more alignments to one or more previously published protein sequences are given at the end of the application. A brief description of the relationship of the variant protein according to the present invention to each such aligned protein is as follows:

Comparison report between T94936_PEA.sub.--1_P2 (SEQ ID NO:206) and Q8TD06 (SEQ ID NO:858) (SEQ ID NO:858):

1. An isolated chimeric polypeptide encoding for T94936_PEA.sub.--1_P2 (SEQ ID NO:206), comprising a first amino acid sequence being at least 90% homologous to MMLHSALGLCLLLVTVSSNLAI-AIKKEKRPPQTLSRGWGDDITWVQTYEEGLFYAQKS KKPLMVIHHLEDCQYSQALKKV-FAQNEEIQEMAQNKFIMLNLMHETTDKNLSPDGQY VPRIMFVDPSLTVRADIAGRYSNRLYTYEPRDLPL corresponding to amino acids 1-150 of Q8TD06 (SEQ ID NO:858), which also corresponds to amino acids 1-150 of T94936_PEA.sub.--1_P2 (SEQ ID NO:206).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a

```
Alignment: TABLE-US-00404 . . . 1
MSLLSSRAARVPGPSSSLCALLVLLLLLTQPGPIASAGPAAAVLRELRCV    50
|||||||||||||||||||||||||||||||||||||||||||||||||    1
MSLLSSRAARVPGPSSSLCALLVLLLLLTQPGPIASAGPAAAVLRELRCV    50 . . . 51

CLQTTQGVHPKMISNLQVFAIGPQCSKVEVV                       81
|||||||||||||||||||||||||||||||                      51
CLQTTQGVHPKMISNLQVFAIGPQCSKVEVV                       81
```

Description for Cluster T94936

Cluster T94936 features 2 transcript(s) and 12 segment(s) of interest, the names for which are given in Tables 1 and 2, respectively, the sequences themselves are given at the end of the application. The selected protein variants are given in table 3. TABLE-US-00405 TABLE 1 Transcripts of interest Transcript Name Sequence ID No. T94936_PEA_1_T1 192 T94936_PEA_1_T2 193

TABLE-US-00406 TABLE 2 Segments of interest Segment Name Sequence ID No. T94936_PEA_1_node_14 194 T94936_PEA_1_node_16 195 T94936_PEA_1_node_2 196 T94936_PEA_1_node_20 197 T94936_PEA_1_node_23 198 T94936_PEA_1_node_0 199 T94936_PEA_1_node_11 200 T94936_PEA_1_node_13 201 T94936_PEA_1_node_17 202 T94936_PEA_1_node_6 203 T94936_PEA_1_node_8 204 T94936_PEA_1_node_9 205 signal peptide, and neither trans-membrane region prediction program predicts that this protein has a trans-membrane region.

Variant protein T94936_PEA.sub.--1_P2 (SEQ ID NO:206) also has the following non-silent SNPs (Single Nucleotide Polymorphisms) as listed in Table 4, (given according to their position(s) on the amino acid sequence, with the alternative amino acid(s) listed; the last column indicates whether the SNP is known or not; the presence of known SNPs in variant protein T94936_PEA.sub.--1_P2 (SEQ ID NO:206) sequence provides support for the deduced sequence of this variant protein according to the present invention). TABLE-US-00408 TABLE 4 Amino acid mutations SNP position(s) on amino acid Alternative sequence amino acid(s) Previously known SNP? 104 T→A No 28 K→R No Variant protein T94936_PEA.sub.--1_P2 (SEQ ID NO:206) is encoded by the following transcript(s): T94936_PEA.sub.--1_T1 (SEQ ID NO:192), for which the sequence(s) is/are given at the end of the application. The coding portion of transcript T94936_PEA.sub.--1_T1 (SEQ ID NO:192) is shown in bold; this coding portion starts at position 76 and ends at position 525. The transcript also has the following SNPs as listed in Table 5 (given according to their position on the nucleotide sequence, with the alternative nucleic acid listed; the last column indicates whether the SNP is known or not; the presence of known SNPs in variant protein T94936_PEA.sub.--1_P2 (SEQ ID NO:206) sequence provides support for the deduced sequence of this variant protein according to the present invention). TABLE-US-00409 TABLE 5 Nucleic acid SNPs SNP position on nucleotide Alternative sequence nucleic acid Previously known SNP? 158 A→G No 186 A→G No 385 A→G No Variant protein T94936_PEA.sub.--1_P3 (SEQ ID NO:207) according to the present invention has an amino acid sequence as given at the end of the application; it is encoded by transcript(s) T94936_PEA.sub.--1_T2 (SEQ ID NO:193). One or more alignments to one or more previously published protein sequences are given at the end of the application. A brief description of the relationship of the variant protein according to the present invention to each such aligned protein is as follows:

Comparison report between T94936_PEA.sub.--1_P3 (SEQ ID NO:207) and Q8TD06 (SEQ ID NO:858):

1. An isolated chimeric polypeptide encoding for T94936_PEA.sub.--1_P3 (SEQ ID NO:207), comprising a first amino acid sequence being at least 90% homologous to MMLHSALGLCLLLVTVSSNLAI-AIKKEKRPPQTLSRGWGDDITWVQTYEEGLFYAQKS KKPLMVIHHLEDCQYSQALKKV-FAQNEEIQEMAQNKFIMLNLMHETTDKNLSPDGQY VPRIMFV corresponding to amino acids 1-122 of Q8TD06 (SEQ ID NO:858), which also corresponds to amino acids 1-122 of T94936_PEA.sub.--1_P3 (SEQ ID NO:207), and a second amino acid sequence being at least 70%, optionally at least 80%, preferably at least 85%, more preferably at least 90% and most preferably at least 95% homologous to a polypeptide having the sequence GMYVISFHQIYKISRN-QHSCFYF (SEQ ID NO: 1019) corresponding to amino acids 123-145 of T94936_PEA.sub.--1_P3 (SEQ ID NO:207), wherein said first and second amino acid sequences are contiguous and in a sequential order.

2. An isolated polypeptide encoding for a tail of T94936_PEA.sub.--1_P3 (SEQ ID NO:207), comprising a polypeptide being at least 70%, optionally at least about 80%, preferably at least about 85%, more preferably at least about 90% and most preferably at least about 95% homologous to the sequence GMYVISFHQIYKISRNQHSCFYF (SEQ ID NO:1019) in T94936_PEA.sub.--1_P3 (SEQ ID NO:207).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T94936_PEA.sub.--1_P3 (SEQ ID NO:207) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein T94936_PEA.sub.--1_P3 (SEQ ID NO:207) sequence provides support for the deduced sequence of this variant protein according to the present invention). TABLE-US-00410 TABLE 6 Amino acid mutations SNP position(s) on amino acid Alternative sequence amino acid(s) Previously known SNP? 104 T→A No 28 K→R No Variant protein T94936_PEA.sub.--1_P3 (SEQ ID NO:207) is encoded by the following transcript(s): T94936_PEA.sub.--1_T2 (SEQ ID NO:193), for which the sequence(s) is/are given at the end of the application. The coding portion of transcript T94936_PEA.sub.--1_T2 (SEQ ID NO:193) is shown in bold; this coding portion starts at position 76 and ends at position 510. The transcript also has the following SNPs as listed in Table 7 (given according to their position on the nucleotide sequence, with the alternative nucleic acid listed; the last column indicates whether the SNP is known or not; the presence of known SNPs in variant protein T94936_PEA.sub.--1_P3 (SEQ ID NO:207) sequence provides support for the deduced sequence of this variant protein according to the present invention). TABLE-US-00411 TABLE 7 Nucleic acid SNPs SNP position on nucleotide Alternative sequence nucleic acid Previously known SNP? 158 A→G No 186 A→G No 385A→G No 746 T→C No 889 A→C No 889 A→G No 980A→No 1006A→No 1105A→No 1356 A→G No As noted above, cluster T94936 features 12 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T94936_PEA.sub.--1_node.sub.--14 (SEQ ID NO:194) according to the present invention is supported by 1 libraries. The number of libraries was determined as previously described. This segment can be found in the following transcript(s): T94936_PEA.sub.--1_T2 (SEQ ID NO:193). Table 8 below describes the starting and ending position of this segment on each transcript. TABLE-US-00412 TABLE 8 Segment location on transcripts Segment Segment Transcript name starting position ending position T94936_PEA__1_T2 (SEQ ID 443 803 NO: 193)

Segment cluster T94936_PEA.sub.--1_node.sub.--16 (SEQ ID NO:195) according to the present invention is supported by 1 libraries. The number of libraries was determined as previously described. This segment can be found in the following transcript(s): T94936_PEA.sub.--1_T2 (SEQ ID NO:193). Table 9 below describes the starting and ending position of this segment on each transcript. TABLE-US-00413 TABLE 9 Segment location on transcripts Segment Segment Transcript name starting position ending position T94936_PEA__1_T2 (SEQ ID 804 1213 NO: 193)

Segment cluster T94936_PEA.sub.--1_node.sub.--2 (SEQ ID NO:196) according to the present invention is supported by 65 libraries. The number of libraries was determined as previously described. This segment can be found in the following transcript(s): T94936_PEA.sub.--1_T1 (SEQ ID NO:192) and T94936_PEA.sub.--1_T2 (SEQ ID NO:193). Table 10 below describes the starting and ending position of this segment on each transcript. TABLE-US-00414 TABLE 10 Segment location on transcripts Segment Segment Transcript name starting position ending position T94936_PEA__1_T1 (SEQ ID 49 184 NO: 192) T94936_PEA__1_T2 (SEQ ID 49 184 NO: 193)

Segment cluster T94936_PEA.sub.--1_node.sub.--20 (SEQ ID NO:197) according to the present invention is supported by 46 libraries. The number of libraries was determined as previously described. This segment can be found in the following transcript(s): T94936_PEA.sub.--1_T2 (SEQ ID NO:193). Table 11 below describes the starting and ending position of this segment on each transcript. TABLE-US-00415 TABLE 11 Segment location on transcripts Segment Segment Transcript name starting position ending position T94936_PEA__1_T2 (SEQ ID 1298 1526 NO: 193)

Segment cluster T94936_PEA.sub.--1_node.sub.--23 (SEQ ID NO:198) according to the present invention is supported by 2 libraries. The number of libraries was determined as previously described. This segment can be found in the following transcript(s): T94936_PEA.sub.--1_T1 (SEQ ID NO:192). Table 12 below describes the starting and ending position of this segment on each transcript. TABLE-US-00416 TABLE 12 Segment location on transcripts Segment Segment Transcript name starting position ending position T94936_PEA__1_T1 (SEQ ID 527 751 NO: 192)

According to an optional embodiment of the present invention, short segments related to the above cluster are also provided. These segments are up to about 120 bp in length, and so are included in a separate description.

Segment cluster T94936_PEA.sub.--1_node.sub.--0 (SEQ ID NO:199) according to the present invention is supported by 32 libraries. The number of libraries was determined as previously described. This segment can be found in the following transcript(s): T94936_PEA.sub.--1_T1 (SEQ ID NO:192) and T94936_PEA.sub.--1_T2 (SEQ ID NO:193). Table 13 below describes the starting and ending position of this segment on each transcript. TABLE-US-00417 TABLE 13 Segment location on transcripts Segment Segment Transcript name starting position ending position T94936_PEA__1_T1 (SEQ ID 1 48 NO: 192) T94936_PEA__1_T2 (SEQ ID 1 48 NO: 193)

Segment cluster T94936_PEA.sub.--1_node.sub.--11 (SEQ ID NO:200) according to the present invention is supported by 61 libraries. The number of libraries was determined as previously described. This segment can be found in the following transcript(s): T94936_PEA.sub.--1_T1 (SEQ ID NO:192) and T94936_PEA.sub.--1_T2 (SEQ ID NO:193). Table 14 below describes the starting and ending position of this segment on each transcript. TABLE-US-00418 TABLE 14 Segment location on transcripts Segment Segment Transcript name starting position ending position T94936_PEA__1_T1 (SEQ ID 302 378 NO: 192) T94936_PEA__1_T2 (SEQ ID 302 378 NO: 193)

Segment cluster T94936_PEA.sub.--1_node.sub.--13 (SEQ ID NO:201) according to the present invention is supported by 50 libraries. The number of libraries was determined as previously described. This segment can be found in the following transcript(s): T94936_PEA.sub.--1_T1 (SEQ ID NO:192) and T94936_PEA.sub.--1_T2 (SEQ ID NO:193). Table 15 below describes the starting and ending position of this segment on each transcript. TABLE-US-00419 TABLE 15 Segment location on transcripts Segment Segment Transcript name starting position ending position T94936_PEA__1_T1 (SEQ ID 379 442 NO: 192) T94936_PEA__1_T2 (SEQ ID 379 442 NO: 193)

Segment cluster T94936_PEA.sub.--1_node.sub.--17 (SEQ ID NO:202) according to the present invention is supported by 51 libraries. The number of libraries was determined as previously described. This segment can be found in the following transcript(s): T94936_PEA.sub.--1_T1 (SEQ ID NO:192) and T94936_PEA.sub.--1_T2 (SEQ ID NO:193). Table 16 below describes the starting and ending position of this segment on each transcript. TABLE-US-00420 TABLE 16 Segment location on transcripts Segment Segment Transcript name starting position ending position T94936_PEA__1_T1 (SEQ ID 443 526 NO: 192) T94936_PEA__1_T2 (SEQ ID 1214 1297 NO: 193)

Segment cluster T94936_PEA.sub.--1 node.sub.--6 (SEQ ID NO:203) according to the present invention is supported by 74 libraries. The number of libraries was determined as previously described. This segment can be found in the following transcript(s): T94936_PEA.sub.--1_T1 (SEQ ID NO:192) and T94936_PEA.sub.--1_T2 (SEQ ID NO:193). Table 17 below describes the starting and ending position of this segment on each transcript. TABLE-US-00421 TABLE 17 Segment location on transcripts Segment Segment Transcript name starting position ending position T94936_PEA__1_T1 (SEQ ID 185 248 NO: 192) T94936_PEA__1_T2 (SEQ ID 185 248 NO: 193)

Segment cluster T94936_PEA.sub.--1_node.sub.--8 (SEQ ID NO:204) according to the present invention can be found in the following transcript(s): T94936_PEA.sub.--1_T1 (SEQ ID NO:192) and T94936_PEA.sub.--1_T2 (SEQ ID NO:193). Table 18 below describes the starting and ending position of this segment on each transcript. TABLE-US-00422 TABLE 18 Segment location on transcripts Segment Segment Transcript name starting position ending position T94936_PEA__1_T1 (SEQ ID 249 252 NO: 192) T94936_PEA__1_T2 (SEQ ID 249 252 NO: 193)

Segment cluster T94936_PEA.sub.--1_node.sub.--9 (SEQ ID NO:205) according to the present invention is supported by 68 libraries. The number of libraries was determined as previously described. This segment can be found in the following transcript(s): T94936_PEA.sub.--1_T1 (SEQ ID NO: 192) and T94936_PEA.sub.--1_T2 (SEQ ID NO:193). Table 19 below describes the starting and ending position of this segment on each transcript. TABLE-US-00423 TABLE 19 Segment location on transcripts Segment Segment Transcript name starting position ending position T94936_PEA__1_T1 (SEQ ID 253 301 NO: 192) T94936_PEA__1_T2 (SEQ ID 253 301 NO: 193)

Variant protein alignment to the previously known protein:
Sequence name: /tmp/1R8BEXWutz/cdFRKHIcZR:Q8TD06 (SEQ ID NO:858).
Sequence documentation:
Alignment of: T94936_PEA.sub.--1_P2 (SEQ ID NO:206).times.Q8TD06 (SEQ ID NO:858).
Alignment segment 1/1: TABLE-US-00424 Quality: 1486.00 Escore: 0 Matching length: 150 Total length: 150 Matching Percent 100.00 Matching Percent Identity: 100.00 Similarity: Total Percent Similarity: 100.00 Total Percent Identity: 100.00 Gaps: 0

```
Alignment: TABLE-US-00425 . . . 1
MMLHSALGLCLLLVTVSSNLAIAIKKEKRPPQTLSRGWGDDITWVQTYEE  50
||||||||||||||||||||||||||||||||||||||||||||||||||  1
MMLHSALGLCLLLVTVSSNLAIAIKKEKRPPQTLSRGWGDDITWVQTYEE  50 . . . 51

GLFYAQKSKKPLMVIHHLEDCQYSQALKKVFAQNEEIQEMAQNKFIMLNL  100
||||||||||||||||||||||||||||||||||||||||||||||||||  51
```

-continued
```
GLFYAQKSKKPLMVIHHLEDCQYSQALKKVFAQNEEIQEMAQNKFIMLNL  100 . . . 101

MHETTDKNLSPDGQYVPRIMFVDPSLTVRADIAGRYSNRLYTYEPRDLPL  150
||||||||||||||||||||||||||||||||||||||||||||||||||  101
MHETTDKNLSPDGQYVPRIMFVDPSLTVRADIAGRYSNRLYTYEPRDLPL  150
```

Sequence name: /tmp/AG3unO0N3y/kjgGehygST: Q8TD06 (SEQ ID NO:858)

Sequence documentation:

Alignment of: T94936_PEA.sub.--1_P3 (SEQ ID NO:207).times.Q8TD06 (SEQ ID NO:858).

Alignment segment 1/1: TABLE-US-00426 Quality: 1214.00 Escore: 0 Matching length: 122 Total length: 122 Matching Percent 100.00 Matching Percent Identity: 100.00 Similarity: Total Percent Similarity: 100.00 Total Percent Identity: 100.00 Gaps: 0

```
Alignment: TABLE-US-00427 . . . 1
MMLHSALGLCLLLVTVSSNLAIAIKKEKRPPQTLSRGWGDDITWVQTYEE  50
||||||||||||||||||||||||||||||||||||||||||||||||||  1
MMLHSALGLCLLLVTVSSNLAIAIKKEKRPPQTLSRGWGDDITWVQTYEE  50 . . . 51

GLFYAQKSKKPLMVIHHLEDCQYSQALKKVFAQNEEIQEMAQNKFIMLNL  100
||||||||||||||||||||||||||||||||||||||||||||||||||  51
GLFYAQKSKKPLMVIHHLEDCQYSQALKKVFAQNEEIQEMAQNKFIMLNL  100 . . . 101

MHETTDKNLSPDGQYVPRIMFV                              122
||||||||||||||||||||||                              101
MHETTDKNLSPDGQYVPRIMFV                              122
```

Expression of Homo sapiens Breast Cancer Membrane Protein 11 (BCMP11) T94936 Transcripts which are Detectable by Amplicon as Depicted in Sequence Name T94936 seg14 (SEQ ID NO:861) in Normal and Cancerous Breast Tissues Expression of Homo sapiens breast cancer membrane protein 11 (BCMP11) transcripts detectable by or according to seg14, T94936 seg14 (SEQ ID NO:861) amplicon(s) and T94936 seg14F (SEQ ID NO:859) and T94936 seg14R (SEQ ID NO:860) primers was measured by real time PCR. In this specific example, the real-time PCR reaction efficiency was assumed to be 2 and was not calculated by a standard curve reaction (as detailed above in the section of "Real-Time RT-PCR analysis"). In parallel the expression of four housekeeping genes—PBGD (GenBank Accession No. BC019323 (SEQ ID NO:926); amplican-PBGD-amplicon (SEQ ID NO:929)), HPRT1 (GenBank Accession No. NM.sub.--000194 (SEQ ID NO:930); amplicon-HPRT 1-amplicon (SEQ ID NO:933)), SDHA (GenBank Accession No. NM.sub.--004168 (SEQ ID NO:922); amplicon-SDHA-amplicon (SEQ ID NO:925)), and G6PD (GenBank Accession No. NM.sub.--000402 (SEQ ID NO:918); G6PD-amplicon (SEQ ID NO:921)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 1, above, "Tissue samples in testing panel"), to obtain a value of fold up-regulation for each sample relative to median of the normal PM samples.

Figure 23:
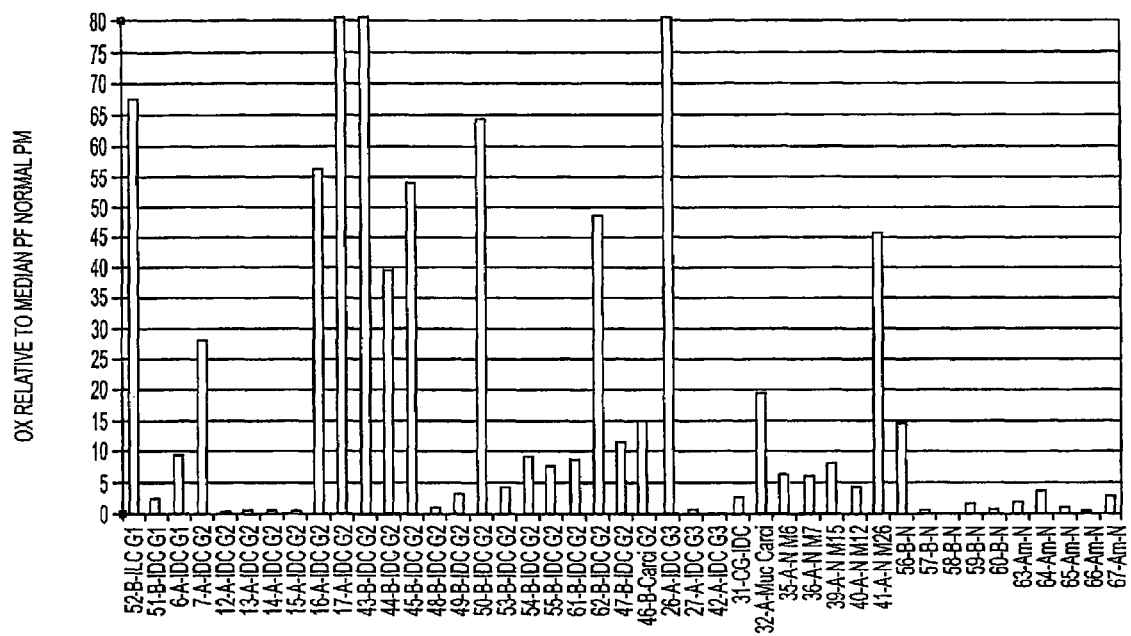
FIG. 23 is a histogram showing the expression of Homo sapiens breast cancer membrane protein 11 (BCMP11) T94936 transcripts which are detectable by amplicon as depicted in sequence name T94936 seg14 (SEQ ID NO:861) in normal and cancerous Breast tissues.

FIG. 23 is a histogram showing over expression of the above-indicated Homo sapiens breast cancer membrane protein 11 (BCMP11) transcripts in cancerous breast samples relative to the normal samples.

As is evident from FIG. 23, the expression of Homo sapiens breast cancer membrane protein 11 (BCMP11) transcripts detectable by the above amplicon(s) in cancer samples was significantly higher than in the non-cancerous samples (Sample Nos. 56-60, 63-67, Table 1, above, "Tissue samples in testing panel"). Notably an over-expression of at least 5 fold was found in 17 out of 28 adenocarcinoma samples.

Statistical analysis was applied to verify the significance of these results, as described below.

The P value for the difference in the expression levels of Homo sapiens breast cancer membrane protein 11 (BCMP11) transcripts detectable by the above amplicon(s) in breast cancer samples versus the normal tissue samples was determined by T test as 7.94E-02.

Threshold of 5 fold overexpression was found to differentiate between cancer and normal samples with P value of 6.74E-03 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: T94936 seg14F forward primer (SEQ ID NO:859); and T94936 seg14R reverse primer (SEQ ID NO:860).

The present invention also preferably encompasses any amplicon obtained through the use of any suitable primer pair; for example, for the above experiment, the following amplicon was obtained as a non-limiting illustrative example only of a suitable amplicon: T94936 seg14 (SEQ ID NO:861). TABLE-US-00428 T94936 seg14 Forward primer: (SEQ ID NO:859) TACAAAATTAGTAGAMTCAGCAT-TCTTGC T94936 seg14 Reverse primer: (SEQ ID NO:860) TGTAGAACTAACAAGAGCTGATATTATTGGAT T94936 seg14 Amplicon: (SEQ ID NO:861) TACAAAATT-AGTAGAAATCAGCATTCTTGCTTT-TATTTTTAAATGCTAGT TCAAGTACTATTCTTTT-TAAAGAGAAGTCATTTCTAATCCAATAATATCA GCTCTTGTTAGTTCTACA Description for Cluster Z41644

Cluster Z41644 features 1 transcript(s) and 21 segment(s) of interest, the names for which are given in Tables 1 and 2, respectively, the sequences themselves are given at the end of the application. The selected protein variants are given in table 3. TABLE-US-00429 TABLE 1 Transcripts of interest Transcript Name Sequence ID No. Z41644_PEA_1_T5 208

TABLE-US-00430 TABLE 2 Segments of interest Segment Name Sequence ID No. Z41644_PEA_1_node_0 209 Z41644_PEA_1_node_11 210 Z41644_PEA_1_node_12 211 Z41644_PEA_1_node_15 212 Z41644_PEA_1_node_20 213 Z41644_PEA_1_node_24 214 Z41644_PEA_1_node_1 215 Z41644_PEA_1_node_10 216 Z41644_PEA_1_node_13 217 Z41644_PEA_1_node_16 218 Z41644_PEA_1_node_17 219 Z41644_PEA_1_node_19 220 Z41644_PEA_1_node_2 221 Z41644_PEA_1_node_21 222 Z41644_PEA_1_node_22 223 Z41644_PEA_1_node_23 224 Z41644_PEA_1_node_25 225 Z41644_PEA_1_node_3 226 Z41644_PEA_1_node_4 227 Z41644_PEA_1_node_6 228 Z41644_PEA_1_node_9 229

TABLE-US-00431 TABLE 3 Proteins of interest Protein Name Sequence ID No. Z41644_PEA_1_P10 231

These sequences are variants of the known protein Small inducible cytokine B14 precursor (SEQ ID NO:230) (SwissProt accession identifier SZ14_HUMAN; known also according to the synonyms CXCL14; Chemokine BRAK), SEQ ID NO: 230, referred to herein as the previously known protein.

Protein Small inducible cytokine B14 precursor (SEQ ID NO:230) is known or believed to have the following function(s): Not chemotactive for T-cells, B-cells, monocytes, natural killer cells or ghranulocytes. Does not inhibit proliferation of myeloid progenitors in colony formation assays. The sequence for protein Small inducible cytokine B14 precursor (SEQ ID NO:230) is given at the end of the application, as "Small inducible cytokine B14 precursor (SEQ ID NO:230) amino acid sequence". Protein Small inducible cytokine B14 precursor (SEQ ID NO:230) localization is believed to be Secreted.

The following GO Annotation(s) apply to the previously known protein. The following annotation(s) were found: chemotaxis; signal transduction; cell-cell signaling, which are annotation(s) related to Biological Process; and chemokine, which are annotation(s) related to Molecular Function.

The GO assignment relies on information from one or more of the SwissProt/TremBI Protein knowledgebase, available from; or Locuslink, available from ncbi.nlm.nih.gov/projects/LocusLink/.

Cluster Z41644 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 24 refer to weighted expression of ESTs in each category, as "parts per million" (ratio of the expression of ESTs for a particular cluster to the expression of all ESTs in that category, according to parts per million).

Figure 24:
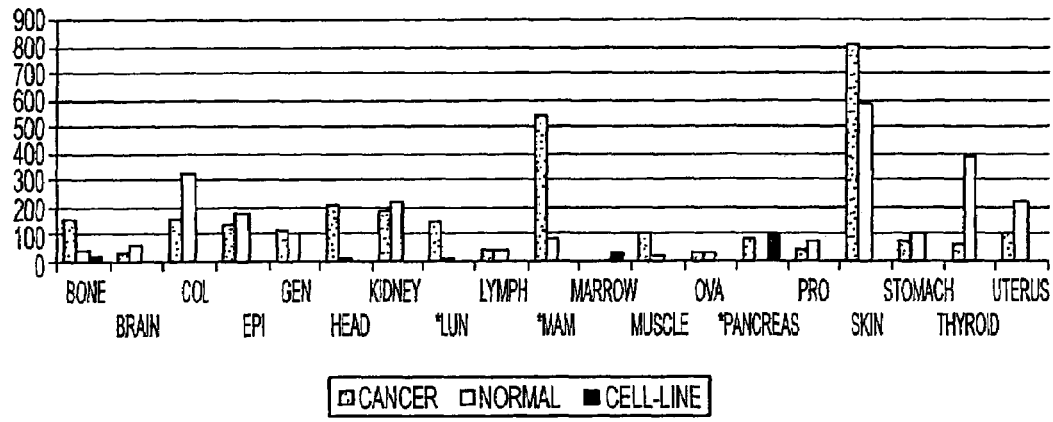
FIG. 24 is a histogram showing Cancer and cell-line vs. normal tissue expression for Cluster Z41644, demonstrating overexpression in lung malignant tumors, breast malignant tumors and pancreas carcinoma.

Overall, the following results were obtained as shown with regard to the histograms in FIG. 24 and Table 4. This cluster is overexpressed (at least at a minimum level) in the following pathological conditions: lung malignant tumors, breast malignant tumors and pancreas carcinoma. TABLE-US-00432 TABLE 4 Normal tissue distribution Name of Tissue Number bone 45 brain 62 colon 327 epithelial 179 general 104 head and neck 10 kidney 219 lung 6 lymph nodes 37 breast 87 bone marrow 0 muscle 20 ovary 36 Pancreas 0 prostate 78 skin 591 stomach 109 Thyroid 386 uterus 218

TABLE-US-00433 TABLE 5 P values and ratios for expression in cancerous tissue Name of Tissue P1 P2 SP1 R3 SP2 R4 bone 4.9e-01 8.5e-01 1.8e-01 1.9 5.3e-01 1.0 brain 6.7e-01 8.0e-01 9.1e-01 0.6 9.9e-01 0.4 colon 6.4e-01 7.7e-01 9.7e-01 0.4 10.3 epithelial 4.1e-01 9.4e-01 9.6e-01 0.7 10.4 general 1.5e-01 9.4e-01 1.8e-01 1.0 10.5 head and neck 1.9e-01 3.3e-01 4.6e-01 2.8 7.5e-01 1.5 kidney 7.7e-01 8.2e-01 7.0e-01 0.7 9.5e-01 0.5 lung 2.2e-01 5.0e-01 1.3e-01 4.8 7.8 8.1e-03 4.1 lymph nodes 6.3e-01 8.7e-01 6.3e-01 1.2 9.2e-01 0.6 breast 4.0e-01 6.5e-01 3.9e-04 3.5 2.9e-02 1.9 bone marrow 1 6.7e-01 11.0 5.3e-01 1.9 muscle 5.2e-01 6.1e-01 2.7e-01 3.2 6.3e-01 1.2 ovary 6.7e-01 7.1e-01 7.6e-01 1.0 8.6e-01 0.8 pancreas 2.2e-02 2.3e-02 5.7e-03 7.8 1.6e-03 8.2 prostate 8.8e-01 9.0e-01 8.3e-01 0.6 9.3e-01 0.5 skin 5.9e-01 6.9e-01 2.3e-01 0.3 10.0 stomach 6.1e-01 8.9e-01 8.1e-01 0.7 9.9e-01 0.4 Thyroid 7.0e-01 7.0e-01 9.9e-01 0.4 9.9e-01 0.4 uterus 5.3e-01 8.2e-01 9.5e-01 0.5 10.3

As noted above, cluster Z41644 features 1 transcript(s), which were listed in Table 1 above. These transcript(s) encode for protein(s) which are variant(s) of protein Small inducible cytokine B14 precursor (SEQ ID NO:230). A description of each variant protein according to the present invention is now provided.

Variant protein Z41644_PEA.sub.--1_P10 (SEQ ID NO:231) according to the present invention has an amino acid sequence as given at the end of the application; it is encoded by transcript(s) Z41644_PEA.sub.--1_T5 (SEQ ID NO:208). An alignment is given to the known protein (Small inducible cytokine B14 precursor (SEQ ID NO:230)) at the end of the application. One or more alignments to one or more previously published protein sequences are given at the end of the application. A brief description of the relationship of the variant protein according to the present invention to each such aligned protein is as follows:

Comparison report between Z41644_PEA.sub.--1_P10 (SEQ ID NO:231) and SZ14_HUMAN (SEQ ID NO:230):

1. An isolated chimeric polypeptide encoding for Z41644_PEA.sub.--1_P10 (SEQ ID NO:231), comprising a first amino acid sequence being at least 90% homologous to MRLLAAALLLLLLALYTARVDGSKCKCS-RKGPKIRYSDVKKLEMKPKYPHCEEKMVII TTKSVS-RYRGQEHCLHPKLQSTKRFIKWYNAWNEKRR corresponding to amino acids 1-95 of SZ14_HUMAN (SEQ ID NO:230), which also corresponds to amino acids 1-95 of Z41644_PEA.sub.--1_P10 (SEQ ID NO:231), and a second amino acid sequence being at least 70%, optionally at least 80%, preferably at least 85%, more preferably at least 90% and most preferably at least 95% homologous to a polypeptide having the sequence YAPPLLTFLPTRPSCGSQDGKG-PPHQVI (SEQ ID NO:1020) corresponding to amino acids 96-123 of Z41644_PEA.sub.--1_P10 (SEQ ID NO:231), wherein said first and second amino acid sequences are contiguous and in a sequential order.

2. An isolated polypeptide encoding for a tail of Z41644_PEA.sub.--1_P10 (SEQ ID NO:231), comprising a polypeptide being at least 70%, optionally at least about 80%, preferably at least about 85%, more preferably at least about 90% and most preferably at least about 95% homologous to the sequence YAPPLLTFLPTRPSCGSQDGKGPPHQVI (SEQ ID NO:1020) in Z41644_PEA.sub.--1_P10 (SEQ ID NO:231).

Comparison report between Z41644_PEA.sub.--1_P10 (SEQ ID NO:231) and Q9NS21 (SEQ ID NO:862):

1. An isolated chimeric polypeptide encoding for Z41644_PEA.sub.--1_P10 (SEQ ID NO:231), comprising a first amino acid sequence being at least 90% homologous to MRLLAAALLLLLLALYTARVDGSKCKCS-RKGPKIRYSDVKKLEMKPKYPHCEEKMVII TTKSVS-RYRGQEHCLHPKLQSTKRFIKWYNAWNEKRR corresponding to amino acids 13-107 of Q9NS21 (SEQ ID NO:862), which also corresponds to amino acids 1-95 of Z41644_PEA.sub.--1_P10 (SEQ ID NO:231), and a second amino acid sequence being at least 70%, optionally at least 80%, preferably at least 85%, more preferably at least 90% and most preferably at least 95% homologous to a polypeptide having the sequence YAPPLLTFLPTRPSCGSQDGKG-PPHQVI (SEQ ID NO:1020) corresponding to amino acids 96-123 of Z41644_PEA.sub.--1_P10 (SEQ ID NO:231), wherein said first and second amino acid sequences are contiguous and in a sequential order.

2. An isolated polypeptide encoding for a tail of Z41644_PEA.sub.--1_P10 (SEQ ID NO:231), comprising a polypeptide being at least 70%, optionally at least about 80%, preferably at least about 85%, more preferably at least about 90% and most preferably at least about 95% homologous to the sequence YAPPLLTFLPTRPSCGSQDGKGPPHQVI (SEQ ID NO:1020) in Z41644_PEA.sub.--1_P10 (SEQ ID NO:231).

Comparison report between Z41644_PEA.sub.--1_P10 (SEQ ID NO:231) and AAQ89265 (SEQ ID NO:863):

1. An isolated chimeric polypeptide encoding for Z41644_PEA.sub.--1_P10 (SEQ ID NO:231), comprising a first amino acid sequence being at least 90% homologous to MRLLAAALLLLLLALYTARVDGSKCKCS-RKGPKIRYSDVKKLEMKPKYPHCEEKMVII TTKSVS-RYRGQEHCLHPKLQSTKRFIKWYNAWNEKRR corresponding to amino acids 13-107 of AAQ89265, which also corresponds to amino acids 1-95 of Z41644_PEA.sub.--1_P10 (SEQ ID NO:231), and a second amino acid sequence being at least 70%, optionally at least 80%, preferably at least 85%, more preferably at least 90% and most preferably at least 95% homologous to a polypeptide having the sequence YAPPLLTFLPTRPSCGSQDGKGPPHQVI (SEQ ID NO:1020) corresponding to amino acids 96-123 of Z41644_PEA.sub.--1_P10 (SEQ ID NO:231), wherein said first and second amino acid sequences are contiguous and in a sequential order.

2. An isolated polypeptide encoding for a tail of Z41644_PEA.sub.--1_P10 (SEQ ID NO:231), comprising a polypeptide being at least 70%, optionally at least about 80%, preferably at least about 85%, more preferably at least about 90% and most preferably at least about 95% homologous to the sequence YAPPLLTFLPTRPSCGSQDGKGPPHQVI (SEQ ID NO:1020) in Z41644_PEA.sub.--1_P10 (SEQ ID NO:231).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z41644_PEA.sub.--1_P10 (SEQ ID NO:231) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein Z41644_PEA.sub.--1_P10 (SEQ ID NO:231) sequence provides support for the deduced sequence of this variant protein according to the present invention). TABLE-US-00434 TABLE 6 Amino acid mutations SNP position(s) on amino acid Alternative amino acid(s) Previously known SNP? 32 P→H Yes 64 S→No 80 T→A No 80 T→P No Variant protein Z41644_PEA.sub.--1_P10 (SEQ ID NO:231) is encoded by the following transcript(s): Z41644_PEA.sub.--1_T5 (SEQ ID NO:208), for which the sequence(s) is/are given at the end of the application. The coding portion of transcript Z41644_PEA.sub.--1_T5 (SEQ ID NO:208) is shown in bold; this coding portion starts at position 744 and ends at position 1112. The transcript also has the following SNPs as listed in Table 7 (given according to their position on the nucleotide sequence, with the alternative nucleic acid listed; the last column indicates whether the SNP is known or not; the presence of known SNPs in variant protein Z41644_PEA.sub.--1_P10 (SEQ ID NO:231) sequence provides support for the deduced sequence of this variant protein according to the present invention). TABLE-US-00435 TABLE 7 Nucleic acid SNPs SNP position on nucleotide Alternative sequence nucleic acid Previously known SNP? 102 A→G Yes 572 C→No 3707 C→T Yes 3735 C→T Yes 4079 G→A No 4123 G→A Yes 4233 A→G Yes 4328 C→No 4350 A→G Yes 4376 G→A Yes 4390 A→G Yes 4619 G→T Yes 838 C→A Yes 4754 C→T No 4757 C→A No 4794 T→G No 4827 G→No 934 C→No 981 A→C No 981 A→G No 1817 A→C Yes 2546 T→No 2684 T→A No 2885 T→C Yes As noted above, cluster Z41644 features 21 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z41644_PEA.sub.--1_node.sub.--0 (SEQ ID NO:209) according to the present invention is supported by 53 libraries. The number of libraries was determined as previously described. This segment can be found in the following transcript(s): Z41644_PEA.sub.--1_T5 (SEQ ID NO:208). Table 8 below describes the starting and ending position of this segment on each transcript. TABLE-US-00436 TABLE 8 Segment location on transcripts Segment Segment starting ending Transcript name position position Z41644_PEA__1_T5 (SEQ ID 1616 NO: 208)

Segment cluster Z41644_PEA.sub.--1_node.sub.--11 (SEQ ID NO:210) according to the present invention is supported by 9 libraries. The number of libraries was determined as previously described. This segment can be found in the following transcript(s): Z41644_PEA.sub.--1_T5 (SEQ ID NO:208). Table 9 below describes the starting and ending position of this segment on each transcript. TABLE-US-00437 TABLE 9 Segment location on transcripts Segment Segment starting ending Transcript name position position Z41644_PEA__1_T5 (SEQ ID 1028 2089 NO: 208)

Segment cluster Z41644_PEA.sub.--1_node.sub.--12 (SEQ ID NO:211) according to the present invention is supported by 6 libraries. The number of libraries was determined as previously described. This segment can be found in the following transcript(s): Z41644_PEA.sub.--1_T5 (SEQ ID NO:208). Table 10 below describes the starting and ending position of this segment on each transcript. TABLE-US-00438 TABLE 10 Segment location on transcripts Segment Segment starting ending Transcript name position position Z41644_PEA__1_T5 (SEQ ID 2090 2350 NO: 208)

Segment cluster Z41644_PEA.sub.--1_node.sub.--15 (SEQ ID NO:212) according to the present invention is supported by 23 libraries. The number of libraries was determined as previously described. This segment can be found in the following transcript(s): Z41644_PEA.sub.--1_T5 (SEQ ID NO:208). Table 11 below describes the starting and ending position of this segment on each transcript. TABLE-US- 00439 TABLE 11 Segment location on transcripts Segment Segment starting ending Transcript name position position Z41644_PEA__1_T5 (SEQ ID 2368 3728 NO: 208)

Segment cluster Z41644_PEA.sub.--1_node.sub.--20 (SEQ ID NO:213) according to the present invention is supported by 260 libraries. The number of libraries was determined as previously described. This segment can be found in the following transcript(s): Z41644_PEA.sub.--1_T5 (SEQ ID NO:208). Table 12 below describes the starting and ending position of this segment on each transcript. TABLE-US-00440 TABLE 12 Segment location on transcripts Segment Segment starting ending Transcript name position position Z41644_PEA__1_T5 (SEQ ID 3938 4506 NO: 208)

Segment cluster Z41644_PEA.sub.--1_node.sub.--24 (SEQ ID NO:214) according to the present invention is supported by 185 libraries. The number of libraries was determined as previously described. This segment can be found in the following transcript(s): Z41644_PEA.sub.--1_T5 (SEQ ID NO:208). Table 13 below describes the starting and ending position of this segment on each transcript. TABLE-US-00441 TABLE 13 Segment location on transcripts Segment Segment starting ending Transcript name position position Z41644_PEA__1_T5 (SEQ ID 4637 4799 NO: 208)

According to an optional embodiment of the present invention, short segments related to the above cluster are also provided. These segments are up to about 120 bp in length, and so are included in a separate description.

Segment cluster Z41644_PEA.sub.--1_node.sub.--1 (SEQ ID NO:215) according to the present invention is supported by 53 libraries. The number of libraries was determined as previously described. This segment can be found in the following transcript(s): Z41644_PEA.sub.--1_T5 (SEQ ID NO:208). Table 14 below describes the starting and ending position of this segment on each transcript. TABLE-US-00442 TABLE 14 Segment location on transcripts Segment Segment starting ending Transcript name position position Z41644_PEA__1_T5 (SEQ ID 617 697 NO: 208)

Segment cluster Z41644_PEA.sub.--1_node.sub.--10 (SEQ ID NO:216) according to the present invention is supported by 138 libraries. The number of libraries was determined as previously described. This segment can be found in the following transcript(s): Z41644_PEA.sub.--1_T5 (SEQ ID NO:208). Table 15 below describes the starting and ending position of this segment on each transcript. TABLE-US-00443 TABLE 15 Segment location on transcripts Segment Segment starting ending Transcript name position position Z41644_PEA__1_T5 (SEQ ID 972 1027 NO: 208)

Segment cluster Z41644_PEA.sub.--1_node.sub.--13 (SEQ ID NO:217) according to the present invention can be found in the following transcript(s): Z41644_PEA.sub.--1_T5 (SEQ ID NO:208). Table 16 below describes the starting and ending position of this segment on each transcript. TABLE-US-00444 TABLE 16 Segment location on transcripts Segment Segment starting ending Transcript name position position Z41644_PEA__1_T5 (SEQ ID 2351 2367 NO: 208)

Segment cluster Z41644_PEA.sub.--1_node.sub.--16 (SEQ ID NO:218) according to the present invention is supported by 152 libraries. The number of libraries was determined as previously described. This segment can be found in the following transcript(s): Z41644_PEA.sub.--1_T5 (SEQ ID NO:208). Table 17 below describes the starting and ending position of this segment on each transcript. TABLE-US-00445 TABLE 17 Segment location on transcripts Segment ending starting position Transcript name position Segment Z41644_PEA__1_T5 (SEQ ID 3729 3809 NO: 208)

Segment cluster Z41644_PEA.sub.--1_node.sub.--17 (SEQ ID NO:219) according to the present invention can be found in the following transcript(s): Z41644_PEA.sub.--1_T5 (SEQ ID NO:208). Table 18 below describes the starting and ending position of this segment on each transcript. TABLE-US-00446 TABLE 18 Segment location on transcripts Segment Segment starting ending Transcript name position position Z41644_PEA__1_T5 (SEQ ID 3810 3829 NO: 208)

Segment cluster Z41644_PEA.sub.--1_node.sub.--19 (SEQ ID NO:220) according to the present invention is supported by 112 libraries. The number of libraries was determined as previously described. This segment can be found in the following transcript(s): Z41644_PEA.sub.--1_T5 (SEQ ID NO:208). Table 19 below describes the starting and ending position of this segment on each transcript. TABLE-US-00447 TABLE 19 Segment location on transcripts Segment Segment starting ending Transcript name position position Z41644_PEA__1_T5 (SEQ ID 3830 3937 NO: 208)

Segment cluster Z41644_PEA.sub.--1_node.sub.--2 (SEQ ID NO:221) according to the present invention is supported by 58 libraries. The number of libraries was determined as previously described. This segment can be found in the following transcript(s): Z41644_PEA.sub.--1_T5 (SEQ ID NO:208). Table 20 below describes the starting and ending position of this segment on each transcript. TABLE-US-00448 TABLE 20 Segment location on transcripts Segment Segment starting ending Transcript name position position Z41644_PEA__1_T5 (SEQ ID 698 737 NO: 208)

Segment cluster Z41644_PEA.sub.--1_node.sub.--21 (SEQ ID NO:222) according to the present invention can be found in the following transcript(s): Z41644_PEA.sub.--1_T5 (SEQ ID NO:208). Table 21 below describes the starting and ending position of this segment on each transcript. TABLE-US-00449 TABLE 21 Segment location on transcripts Segment Segment starting ending Transcript name position position Z41644_PEA__1_T5 (SEQ ID 4507 4529 NO: 208)

Segment cluster Z41644_PEA.sub.--1_node.sub.--22 (SEQ ID NO:223) according to the present invention is supported by 164 libraries. The number of libraries was determined as previously described. This segment can be found in the following transcript(s): Z41644_PEA.sub.--1_T5 (SEQ ID NO:208). Table 22 below describes the starting and ending position of this segment on each transcript. TABLE-US-00450 TABLE 22 Segment location on transcripts Segment Segment starting ending Transcript name position position Z41644_PEA__1_T5 (SEQ ID 4530 4582 NO: 208)

Segment cluster Z41644_PEA.sub.--1_node.sub.--23 (SEQ ID NO:224) according to the present invention is supported by 169 libraries. The number of libraries was determined as previously described. This segment can be found in the following transcript(s): Z41644_PEA.sub.--1_T5 (SEQ ID NO:208). Table 23 below describes the starting and ending position of this segment on each transcript. TABLE-US-00451 TABLE 23 Segment location on transcripts Segment Segment starting ending Transcript name position position Z41644_PEA__1_T5 (SEQ ID 4583 4636 NO: 208)

Segment cluster Z41644_PEA.sub.--1_node.sub.--25 (SEQ ID NO:225) according to the present invention is supported by 138 libraries. The number of libraries was determined as previously described. This segment can be found in the following transcript(s): Z41644_PEA.sub.--1_T5 (SEQ ID NO:208). Table 24 below describes the starting and ending position of this segment on each transcript. TABLE-US-00452 TABLE 24 Segment location on transcripts Segment Segment starting ending Transcript name position position Z41644_PEA__$_{b\,1}$_T5 (SEQ ID 4800 4902 NO: 208)

Segment cluster Z41644_PEA.sub.--1_node.sub.--3 (SEQ ID NO:226) according to the present invention is supported by 75 libraries. The number of libraries was determined as previously described. This segment can be found in the following transcript(s): Z41644_PEA.sub.--1_T5 (SEQ ID NO:208). Table 25 below describes the starting and ending position of this segment on each transcript. TABLE-US-00453 TABLE 25 Segment location on transcripts Segment Segment starting ending Transcript name position position Z41644_PEA__1_T5 (SEQ ID 738 773 NO: 208)

Segment cluster Z41644_PEA.sub.--1_node.sub.--4 (SEQ ID NO:227) according to the present invention is supported by 61 libraries. The number of libraries was determined as previously described. This segment can be found in the following transcript(s): Z41644_PEA.sub.--1_T5 (SEQ ID NO:208). Table 26 below describes the starting and ending position of this segment on each transcript. TABLE-US-00454 TABLE 26 Segment location on transcripts Segment 00456 TABLE 28 Segment location on transcripts Segment Segment starting ending Transcript name position position Z41644_PEA__1_T5 (SEQ ID 914 971 NO: 208)

Variant protein alignment to the previously known protein:

Sequence name: /tmp/p5SSvhT9Xp/HQeIMsUrfm: SZ14_HUMAN (SEQ ID NO:230)

Sequence documentation:

Alignment of: Z41644_PEA.sub.--1_P10 (SEQ ID NO:231).times.SZ14_HUMAN (SEQ ID NO:230).

Alignment segment 1/1: TABLE-US-00457 Quality: 953.00 Escore: 0 Matching length: 95 Total length: 95 Matching Percent 100.00 Matching Percent Identity: 100.00 Similarity: Total Percent Similarity: 100.00 Total Percent Identity: 100.00 Gaps: 0

```
Alignment: TABLE-US-00458 . . . 1
MRLLAAALLLLLLALYTARVDGSKCKCSRKGPKIRYSDVKKLEMKPKYPH   50
|||||||||||||||||||||||||||||||||||||||||||||||||    1
MRLLAAALLLLLLALYTARVDGSKCKCSRKGPKIRYSDVKKLEMKPKYPH   50 . . . 51

CEEKMVIITTKSVSRYRGQEHCLHPKLQSTKRFIKWYNAWNEKRR        95
||||||||||||||||||||||||||||||||||||||||||||        51
CEEKMVIITTKSVSRYRGQEHCLHPKLQSTKRFIKWYNAWNEKRR        95
```

Segment starting ending Transcript name position position Z41644_PEA__1_T5 (SEQ ID 774 807 NO: 208)

Segment cluster Z41644_PEA.sub.--1_node.sub.--6 (SEQ ID NO:228) according to the present invention is supported by 101 libraries. The number of libraries was determined as previously described. This segment can be found in the following transcript(s): Z41644_PEA.sub.--1_T5 (SEQ ID NO:208). Table 27 below describes the starting and ending position of this segment on each transcript. TABLE-US- Sequence name: /tmp/p5SSvhT9Xp/HQeIMsUrfm: Q9NS21 (SEQ ID NO:862)

Sequence documentation:

Alignment of: Z41644_PEA.sub.--1_P10 (SEQ ID NO:231).times.Q9NS21 (SEQ ID NO:862).

Alignment segment 1/1: TABLE-US-00459 Quality: 957.00 Escore: 0 Matching length: 96 Total length: 96 Matching Percent 100.00 Matching Percent Identity: 98.96 Similarity: Total Percent Similarity: 100.00 Total Percent Identity: 98.96 Gaps: 0

```
Alignment: TABLE-US-00460 . . . 1
MRLLAAALLLLLLALYTARVDGSKCKCSRKGPKIRYSDVKKLEMKPKYPH   50
|||||||||||||||||||||||||||||||||||||||||||||||||   13
MRLLAAALLLLLLALYTARVDGSKCKCSRKGPKIRYSDVKKLEMKPKYPH   62 . . . 51

CEEKMVIITTKSVSRYRGQEHCLHPKLQSTKRFIKWYNAWNEKRRY       96
|||||||||||||||||||||||||||||||||||||||||||| :      63
CEEKMVIITTKSVSRYRGQEHCLHPKLQSTKRFIKWYNAWNEKRRF       108
```

00455 TABLE 27 Segment location on transcripts Segment Segment starting ending Transcript name position position Z41644_PEA__1_T5 (SEQ ID 808 913 NO: 208)

Segment cluster Z41644_PEA.sub.--1_node.sub.--9 (SEQ ID NO:229) according to the present invention is supported by 134 libraries. The number of libraries was determined as previously described. This segment can be found in the following transcript(s): Z41644_PEA.sub.--1_T5 (SEQ ID NO:208). Table 28 below describes the starting and ending position of this segment on each transcript. TABLE-US- Sequence name: /tmp/p5SSvhT9Xp/HQeIMsUrfm: AAQ89265

Sequence documentation:

Alignment of: Z41644_PEA.sub.--1_P10 (SEQ ID NO:231).times.AAQ89265.

Alignment segment 1/1: TABLE-US-00461 Quality: 953.00 Escore: 0 Matching length: 95 Total length: 95 Matching Percent 100.00 Matching Percent Identity: 100.00 Similarity: Total Percent Similarity: 100.00 Total Percent Identity: 100.00 Gaps: 0

```
Alignment: TABLE-US-00462 . . . 1
MRLLAAALLLLLLALYTARVDGSKCKCSRKGPKIRYSDVKKLEMKPKYPH   50
|||||||||||||||||||||||||||||||||||||||||||||       13
MRLLAAALLLLLLALYTARVDGSKCKCSRKGPKIRYSDVKKLEMKPKYPH   62 . . . 51

CEEKMVIITTKSVSRYRGQEHCLHPKLQSTKRFIKWYNAWNEKRR        95
||||||||||||||||||||||||||||||||||||||||||||        63
CEEKMVIITTKSVSRYRGQEHCLHPKLQSTKRFIKWYNAWNEKRR        107
```

Description for Cluster M85491

Cluster AA85491 features 2 transcript(s) and 11 segment(s) of interest, the names for which are given in Tables 1 and 2, respectively, the sequences themselves are given at the end of the application. The selected protein variants are given in table 3. TABLE-US-00463 TABLE 1 Transcripts of interest Transcript Name Sequence ID No. M85491_PEA__1_T16 232 M85491_PEA__1_T20 233

TABLE-US-00464 TABLE 2 Segments of interest Segment Name Sequence ID No. M85491_PEA__1_node__0 234 M85491_PEA__1_node__13 235 M85491_PEA__1_node__21 236 M85491_PEA__1_node__23 237 M85491_PEA__1_node__24 238 M85491_PEA__1_node__8 239 M85491_PEA__1_node__9 240 M85491_PEA__1_node__10 241 M85491_PEA__1_node__18 242 M85491_PEA__1_node__19 243 M85491_PEA__1_node__6 244

TABLE-US-00465 TABLE 3 Proteins of interest Protein Name Sequence ID No. M85491_PEA__1_P13 246 M85491_PEA—1_P14 247

These sequences are variants of the known protein Ephrin type-B receptor 2 [precursor] (SEQ ID NO:245) (SwissProt accession identifier EPB2_HUMAN; known also according to the synonyms EC 2.7.1.112; Tyrosine-protein kinase receptor EPH-3; DRT; Receptor protein-tyrosine kinase HEK5; ERK), SEQ ID NO: 245, referred to herein as the previously known protein.

Protein Ephrin type-B receptor 2 [precursor] (SEQ ID NO:245) is known to have the following function(s): Receptor for members of the ephrin-B family. The sequence for protein Ephrin type-B receptor 2 [precursor] (SEQ ID NO:245) is given at the end of the application, as "Ephrin type-B receptor 2 [precursor] (SEQ ID NO:245) amino acid sequence". Known polymorphisms for this sequence are as shown in Table 4. TABLE-US-00466 TABLE 4 Amino acid mutations for Known Protein SNPposition(s) on amino acid sequence Comment 671 A→R./FTId=VAR__004162.120 MALRRLGAALLLLPLLMVE→MWVPVLALPVCTYA 923 E→K 956 L→V 958 V→L 154 G→D 476 K→KQ 495-496 Missing 532 E→D 568 R→RR 589 M→1788I→F 853 S→A Protein Ephrin type-B receptor 2 [precursor] (SEQ ID NO:245) localization is believed to be Type I membrane protein.

The following GO Annotation(s) apply to the previously known protein. The following annotation(s) were found: protein amino acid phosphorylation; transmembrane receptor protein tyrosine kinase signaling pathway; neurogenesis, which are annotation(s) related to Biological Process; protein tyrosine kinase; receptor; transmembrane-ephrin receptor; ATP binding; transferase, which are annotation(s) related to Molecular Function; and integral membrane protein, which are annotation(s) related to Cellular Component.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster M85491 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 25 refer to weighted expression of ESTs in each category, as "parts per million" (ratio of the expression of ESTs for a particular cluster to the expression of all ESTs in that category, according to parts per million).

Figure 25:
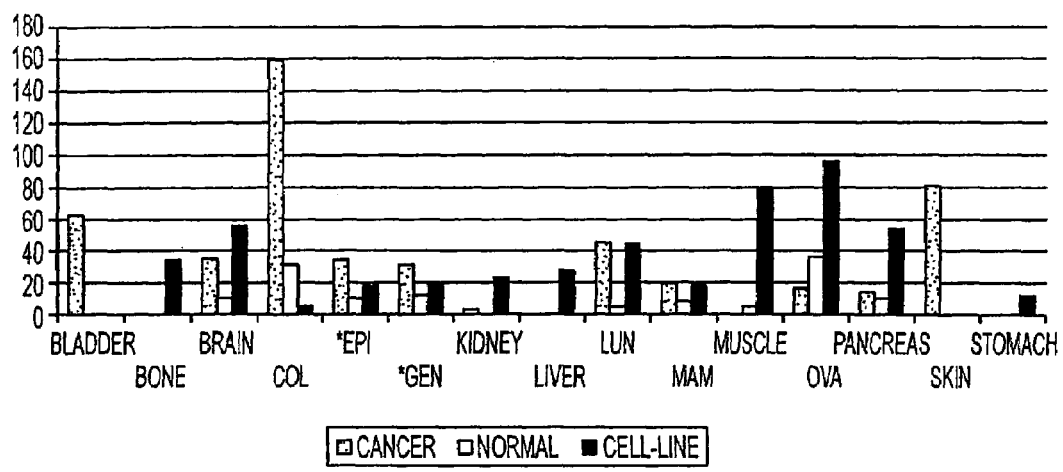
FIG. 25 is a histogram showing Cancer and cell-line vs. normal tissue expression for Cluster M85491, demonstrating overexpression in epithelial malignant tumors and a mixture of malignant tumors from different tissues.

Overall, the following results were obtained as shown with regard to the histograms in FIG. 25 and Table 5. This cluster is overexpressed (at least at a minimum level) in the following pathological conditions: epithelial malignant tumors and a mixture of malignant tumors from different tissues. TABLE-US-00467 TABLE 5 Normal tissue distribution Name of Tissue Number Bladder 0 Bone 0 Brain 10 Colon 31 epithelial 10 general 12 Kidney 0 Liver 0 Lung 5 Breast 8 Muscle 5 Ovary 36 pancreas 10 Skin 0 stomach 0

TABLE-US-00468 TABLE 6 P values and ratios for expression in cancerous tissue Name of Tissue P1 P2 SP1 R3 SP2 R4 bladder 5.4e-01 6.0e-01 3.2e-01 2.5 4.6e-01 1.9 Bone 1 2.8e-011 1.0 7.0e-01 1.8 Brain 3.4e-01 3.6e-01 1.2e-01 2.9 1.8e-02 2.7 Colon 3.4e-02 5.7e-02 8.2e-02 2.8 2.0e-01 2.1 epithelial 1.7e-03 3.5e-03 2.0e-03 2.8 1.1e-02 2.2 general 4.8e-04 5.2e-04 6.7e-04 2.3 1.3e-03 1.9 Kidney 4.3e-01 3.7e-01 11.17.0e-01 1.5 Liver 1 4.5e-01 1 1.0 6.9e-01 1.5 Lung 2.2e-01 2.7e-01 6.9e-02 3.6 3.4e-02 3.6 Breast 8.2e-01 7.3e-01 6.9e-01 1.2 6.8e-01 1.2 Muscle 9.2e-01 4.8e-01 1 0.8 1.5e-01 3.2 Ovary 8.5e-01 7.3e-01 9.0e-01 0.7 6.7e-01 1.0 pancreas 5.5e-01 2.0e-01 6.7e-01 1.2 3.5e-01 1.8 Skin 2.9e-01 4.7e-01 1.4e-01 7.0 6.4e-01 1.6 stomach 1.5e-01 3.2e-01 11.0 8.0e-01 1.3

As noted above, cluster M85491 features 2 transcript(s), which were listed in Table 1 above. These transcript(s) encode for protein(s) which are variant(s) of protein Ephrin type-B receptor 2 [precursor]. A description of each variant protein according to the present invention is now provided.

Variant protein M85491_PEA.sub.--1_P13 (SEQ ID NO:246) according to the present invention has an amino acid sequence as given at the end of the application; it is encoded by transcript(s) M85491_PEA.sub.--1_T16 (SEQ ID NO:232). An alignment is given to the known protein (Ephrin type-B receptor 2 [precursor]) at the end of the application. One or more alignments to one or more previously published protein sequences are given at the end of the application. A brief description of the relationship of the variant protein according to the present invention to each such aligned protein is as follows:

Comparison report between M85491_PEA.sub.--1_P13 (SEQ ID NO:246) and EPB2_HUMAN (SEQ ID NO:245):

1. An isolated chimeric polypeptide encoding for M8549 1_PEA.sub.--1_P13 (SEQ ID NO:246), comprising a first amino acid sequence being at least 90% homologous to MALRRLGAALLLLPLLAAVEETLMDST-TATAELGWMVHPPSGWEEVSGYDENMNTIR TYQVCNVFESSQNNWLRTKFIR-RRGAHRIHVEMKFSVRDCSSIPSVPGSCKETFNLYYY EADFDSATKTFPNWMENPWVKVDTIM-DESFSQVDLGGRVMKINTEVRSFGPVSRSGF YLAFQDYGGCMSLIAVRVFYRKCPRI-IQNGAIFQETLSGAESTSLVAARGSCIANAEEVD VPIKLYCNGDGEWLVPIGRCMCKAG-FEAVENGTVCRGCPSGTFKANQGDEACTHCPIN SRTTSEGATNCVCRNGYYRADLDPLD-MPCTTIPSAPQAVISSVNETSLMLEWTPPRDSG GREDLVYNIICKSCGSGRGACTRCGDN-VQYAPRQLGLTEPRIYISDLLAHTQYTFEIQAV NGVT-DQSPFSPQFASVNITTNQAAPSAVSIM-HQVSRTVDSITLSWSQPDQPNGVILDYEL QYYEK corresponding to amino acids 1-476 of EPB2_HUMAN (SEQ ID NO:245), which also corresponds to amino acids 1-476 of M85491_PEA.sub.--1_P13 (SEQ ID NO:246), and a second amino acid sequence being at least 70%, optionally at least 80%, preferably at least 85%, more preferably at least 90% and most preferably at least 95% homologous to a polypeptide having the sequence VPIGWVLSPSPTSLRA-PLPG (SEQ ID NO:964) corresponding to amino acids 477-496 of M85491_PEA.sub.--1_P13 (SEQ ID NO:246), wherein said first and second amino acid sequences are contiguous and in a sequential order.

2. An isolated polypeptide encoding for a tail of M85491_PEA.sub.--1_P 13 (SEQ ID NO:246), comprising a polypeptide being at least 70%, optionally at least about 80%, preferably at least about 85%, more preferably at least about 90% and most preferably at least about 95% homologous to the sequence VPIGWVLSPSPTSLRAPLPG (SEQ ID NO:964) in M85491_PEA.sub.--1_P13 (SEQ ID NO:246).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region. Variant protein M85491_PEA.sub.--1_P13 (SEQ ID NO:246) is encoded by the following transcript(s): M85491_PEA.sub.--1_T16 (SEQ ID NO:232), for which the sequence(s) is/are given at the end of the application. The coding portion of transcript M85491_PEA.sub.--1_T16 (SEQ ID NO:232) is shown in bold; this coding portion starts at position 143 and ends at position 1630. The transcript also has the following SNPs as listed in Table 7 (given according to their position on the nucleotide sequence, with the alternative nucleic acid listed; the last column indicates whether the SNP is known or not; the presence of known SNPs in variant protein M85491_PEA.sub.--1_P13 (SEQ ID NO:246) sequence provides support for the deduced sequence of this variant protein according to the present invention). TABLE-US-00469 TABLE 7 Nucleic acid SNPs SNP position on Alternative Previously nucleotide sequence nucleic acid known SNP? 799 G→A Yes 1066 C→T Yes 1519 A→G Yes 1872 C→T Yes 2044 T→C Yes 2156 G→A Yes 2606 C→A Yes 2637 G→C Yes Variant protein M85491_PEA.sub.--1_P14 (SEQ ID NO:247) according to the present invention has an amino acid sequence as given at the end of the application; it is encoded by transcript(s) M85491_PEA.sub.--1_T20 (SEQ ID NO:233). An alignment is given to the known protein (Ephrin type-B receptor 2 [precursor]) at the end of the application. One or more alignments to one or more previously published protein sequences are given at the end of the application. A brief description of the relationship of the variant protein according to the present invention to each such aligned protein is as follows:

Comparison report between M85491_PEA.sub.--1_P14 (SEQ ID NO:247) and EPB2_HUMAN (SEQ ID NO:245):

1. An isolated chimeric polypeptide encoding for M85491_PEA.sub.--1_P14 (SEQ ID NO:247), comprising a first amino acid sequence being at least 90% homologous to MALRRLGAALLLLPLLMVEETLMDSTTA-TAELGWMVHPPSGWEEVSGYDENMNTIR TYQVCN-VFESSQNNWLRTKFIRRRGAHRIH-VEMKFSVRDCSSIPSVPGSCKETFNLYYY EADFDSATKTFPNWMENPWVKVDTIM-DESFSQVDLGGRVMKINTEVRSFGPVSRSGF YLAFQDYGGCMSLIAVRVFYRKCPRI-IQNGAIFQETLSGAESTSLVMRGSCIANAEEVD VPIK-LYCNGDGEWLVPIGRCMCKAGFEAVENGTVCR corresponding to amino acids 1-270 of EPB2_HUMAN (SEQ ID NO:245), which also corresponds to amino acids 1-270 of M85491_PEA.sub.--1_P14 (SEQ ID NO:247), and a second amino acid sequence being at least 70%, optionally at least 80%, preferably at least 85%, more preferably at least 90% and most preferably at least 95% homologous to a polypeptide having the sequence ERQDLTMLSRLVLNSW-PQMILPPQPPPKVLEL (SEQ ID NO:965) corresponding to amino acids 271-301 of M85491_PEA.sub.--1_P14 (SEQ ID NO:247), wherein said first and second amino acid sequences are contiguous and in a sequential order.

2. An isolated polypeptide encoding for a tail of M85491_PEA.sub.--1_P14 (SEQ ID NO:247), comprising a polypeptide being at least 70%, optionally at least about 80%, preferably at least about 85%, more preferably at least about 90% and most preferably at least about 95% homologous to the sequence ERQDLTMLSRLVLNSWPQMILPPQPPPKV-LEL (SEQ ID NO:965) in M85491_PEA.sub.--1_P14 (SEQ ID NO:247).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M85491_PEA.sub.--1_P14 (SEQ ID NO:247) is encoded by the following transcript(s): M85491_PEA.sub.--1_T20 (SEQ ID NO:233), for which the sequence(s) is/are given at the end of the application. The coding portion of transcript M85491_PEA.sub.--1_T20 (SEQ ID NO:233) is shown in bold; this coding portion starts at position 143 and ends at position 1045. The transcript also has the following SNPs as listed in Table 8 (given according to their position on the nucleotide sequence, with the alternative nucleic acid listed; the last column indicates whether the SNP is known or not; the presence of known SNPs in variant protein M85491_PEA.sub.--1_P14 (SEQ ID NO:247) sequence provides support for the deduced sequence of this variant protein according to the present invention). TABLE-US-00470-TABLE 8 Nucleic acid SNPs SNP position on Alternative Previously nucleotide sequence nucleic acid known SNP? 799 G→A Yes 1135 T→C Yes 1160 T→C Yes 1172A→C Yes 1176 T→A Yes As noted above, cluster M85491 features 11 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster M85491_PEA.sub.--1_node.sub.--0 (SEQ ID NO:234) according to the present invention is supported by 5 libraries. The number of libraries was determined as previously described. This segment can be found in the following transcript(s): M85491_PEA.sub.--1_T16 (SEQ ID NO:232) and M85491_PEA.sub.--1_T20 (SEQ ID NO:233). Table 9 below describes the starting and ending position of this segment on each transcript. TABLE-US-00471 TABLE 9 Segment location on transcripts Segment Segment Transcript name starting position ending position M85491_PEA__1_T16 (SEQ 1 203 ID NO: 232) M85491_PEA__1_T20 (SEQ 1 203 ID NO: 233)

Segment cluster M85491_PEA.sub.--1_node.sub.--13 (SEQ ID NO:235) according to the present invention is supported by 6 libraries. The number of libraries was determined as previously described. This segment can be found in the following transcript(s): M85491_PEA.sub.--1_T20 (SEQ ID NO:233). Table 10 below describes the starting and ending position of this segment on each transcript. TABLE-US-00472 TABLE 10 Segment location on transcripts Segment Segment Transcript name starting position ending position M85491_PEA__1_T20 (SEQ 954 1182 ID NO: 233)

Segment cluster M85491_PEA.sub.--1_node.sub.--21 (SEQ ID NO:236) according to the present invention is supported by 18 libraries. The number of libraries was determined as previously described. This segment can be found in the following transcript(s): M85491_PEA.sub.--1_T16 (SEQ ID NO:232). Table 12 below describes the starting and ending position of this segment on each transcript. TABLE-US-00473 TABLE 12 Segment location on transcripts Segment Segment Transcript name starting position ending position M85491_PEA__1_T16 (SEQ 1110 1445 ID NO: 232)

Segment cluster M85491_PEA.sub.--1_node.sub.--23 (SEQ ID NO:237) according to the present invention is supported by 18 libraries. The number of libraries was determined as previously described. This segment can be found in the following transcript(s): M85491_PEA.sub.--1_T16 (SEQ ID NO:232). Table 13 below describes the starting and ending position of this segment on each transcript. TABLE-US-00474 TABLE 13 Segment location on transcripts Segment Segment Transcript name starting position ending position M85491_PEA__1_T16 (SEQ 1446 1570 ID NO: 232)

Segment cluster M85491_PEA.sub.--1_node.sub.--24 (SEQ ID NO:238) according to the present invention is supported by 3 libraries. The number of libraries was determined as previously described. This segment can be found in the following transcript(s): M85491_PEA.sub.--1_T16 (SEQ ID NO:232). Table 14 below describes the starting and ending position of this segment on each transcript. TABLE-US-00475 TABLE 14 Segment location on transcripts Segment Segment Transcript name starting position ending position M85491_PEA__1_T16 (SEQ 1571 2875 ID NO: 232)

Segment cluster M85491_PEA.sub.--1_node.sub.--8 (SEQ ID NO:239) according to the present invention is supported by 25 libraries. The number of libraries was determined as previously described. This segment can be found in the following transcript(s): M85491_PEA.sub.--1_T16 (SEQ ID NO:232) and M85491_PEA.sub.--1_T20 (SEQ ID NO:233). Table 15 below describes the starting and ending position of this segment on each transcript. TABLE-US-00476 TABLE 15 Segment location on transcripts Segment Segment Transcript name starting position ending position M85491_PEA__1_T16 (SEQ 269 672 ID NO: 232) M85491_PEA__1_T20 (SEQ 269 672 ID NO: 233)

Segment cluster M85491_PEA.sub.--1_node.sub.--9 (SEQ ID NO:240) according to the present invention is supported by 20 libraries. The number of libraries was determined as previously described. This segment can be found in the following transcript(s): M85491_PEA.sub.--1_T16 (SEQ ID NO:232) and M85491_PEA.sub.--1_T20 (SEQ ID NO:233). Table 17 below describes the starting and ending position of this segment on each transcript. TABLE-US-00477 TABLE 17 Segment location on transcripts Segment Segment Transcript name starting position ending position M85491_PEA__1_T16 (SEQ 673 856 ID NO: 232) M85491_PEA__1_T20 (SEQ 673 856 ID NO: 233)

According to an optional embodiment of the present invention, short segments related to the above cluster are also provided. These segments are up to about 120 bp in length, and so are included in a separate description.

Segment cluster M85491_PEA.sub.--1_node.sub.--10 (SEQ ID NO:241) according to the present invention is supported by 17 libraries. The number of libraries was determined as previously described. This segment can be found in the following transcript(s): M85491_PEA.sub.--1_T16 (SEQ ID NO:232) and M85491_PEA.sub.--1_T20 (SEQ ID NO:233). Table 18 below describes the starting and ending position of this segment on each transcript. TABLE-US-00478 TABLE 18 Segment location on transcripts Segment Segment Transcript name starting position ending position M85491_PEA__1_T16 (SEQ 857 953 ID NO: 232) M85491_PEA__1_T20 (SEQ 857 953 ID NO: 233)

Segment cluster M85491_PEA.sub.--1_node.sub.--18 (SEQ ID NO:242) according to the present invention is supported by 15 libraries. The number of libraries was determined as previously described. This segment can be found in the following transcript(s): M85491_PEA.sub.--1_T16 (SEQ ID NO:232). Table 19 below describes the starting and ending position of this segment on each transcript. TABLE-US-00479 TABLE 19 Segment location on transcripts Segment Segment Transcript name starting position ending position M85491_PEA__1_T16 (SEQ 954 1044 ID NO: 232)

Segment cluster M85491_PEA.sub.--1_node.sub.--19 (SEQ ID NO:243) according to the present invention is supported by 15 libraries. The number of libraries was determined as previously described. This segment can be found in the following transcript(s): M85491_PEA.sub.--1_T16 (SEQ ID NO:232). Table 20 below describes the starting and ending position of this segment on each transcript. TABLE-US-00480 TABLE 20 Segment location on transcripts Segment Segment Transcript name starting position ending position M85491_PEA__1_T16 (SEQ 1045 1109 ID NO: 232)

Segment cluster M85491_PEA.sub.--1_node.sub.--6 (SEQ ID NO:244) according to the present invention is supported by 11 libraries. The number of libraries was determined as previously described. This segment can be found in the following transcript(s): M85491_PEA.sub.--1_T16 (SEQ ID NO:232) and M85491_PEA.sub.--1_T20 (SEQ ID NO:233). Table 21 below describes the starting and ending position of this segment on each transcript. TABLE-US-00481 TABLE 21 Segment location on transcripts Segment Segment Transcript name starting position ending position M85491_PEA__1_T16 (SEQ 204 268 ID NO: 232) M85491_PEA__1_T20 (SEQ 204 268 ID NO: 233)

Variant protein alignment to the previously known protein:

Sequence name: /tmp/qfmsU9VtxS/DylcLC9j8v: EPB2_HUMAN (SEQ ID NO:245)

Sequence documentation:

Alignment of: M85491_PEA.sub.--1_P13 (SEQ ID NO:246).times.EPB2_HUMAN (SEQ ID NO:245).

Alignment segment 1/1: TABLE-US-00482 Quality: 4726.00 Escore: 0 Matching length: 476 Total length: 476 Matching Percent 100.00 Matching Percent Identity: 100.00 Similarity: Total Percent Similarity: 100.00 Total Percent Identity: 100.00 Gaps: 0

```
Alignment: TABLE-US-00483 . . . 1
MALRRLGAALLLLPLLAAVEETLMDSTTATAELGWMVHPPSGWEEVSGYD    50
|||||||||||||||||||||||||||||||||||||||||||||||||     1
MALRRLGAALLLLPLLAAVEETLMDSTTATAELGWMVHPPSGWEEVSGYD    50 . . . 51
```

-continued

```
ENMNTIRTYQVCNVFESSQNNWLRTKFIRRRGAHRIHVEMKFSVRDCSSI   100
||||||||||||||||||||||||||||||||||||||||||||||||||   51
ENMNTIRTYQVCNVFESSQNNWLRTKFIRRRGAHRIHVEMKFSVRDCSSI   100 . . . 101

PSVPGSCKETFNLYYYEADFDSATKTFPNWMENPWVKVDTIAADESFSQV   150
||||||||||||||||||||||||||||||||||||||||||||||||||   101
PSVPGSCKETFNLYYYEADFDSATKTFPNWMENPWVKVDTIAADESFSQV   150 . . . 151

DLGGRVMKINTEVRSFGPVSRSGFYLAFQDYGGCMSLIAVRVFYRKCPRI   200
||||||||||||||||||||||||||||||||||||||||||||||||||   151
DLGGRVMKINTEVRSFGPVSRSGFYLAFQDYGGCMSLIAVRVFYRKCPRI   200 . . . 201

IQNGAIFQETLSGAESTSLVAARGSCIANAEEVDVPIKLYCNGDGEWLVP   250
||||||||||||||||||||||||||||||||||||||||||||||||||   201
IQNGAIFQETLSGAESTSLVAARGSCIANAEEVDVPIKLYCNGDGEWLVP   250 . . . 251

IGRCMCKAGFEAVENGTVCRGCPSGTFKANQGDEACTHCPINSRTTSEGA   300
||||||||||||||||||||||||||||||||||||||||||||||||||   251
IGRCMCKAGFEAVENGTVCRGCPSGTFKANQGDEACTHCPINSRTTSEGA   300 . . . 301

TNCVCRNGYYRADLDPLDMPCTTIPSAPQAVISSVNETSLMLEWTPPRDS   350
||||||||||||||||||||||||||||||||||||||||||||||||||   301
TNCVCRNGYYRADLDPLDMPCTTIPSAPQAVISSVNETSLMLEWTPPRDS   350 . . . 351

GGREDLVYNIICKSCGSGRGACTRCGDNVQYAPRQLGLTEPRIYISDLLA   400
||||||||||||||||||||||||||||||||||||||||||||||||||   351
GGREDLVYNIICKSCGSGRGACTRCGDNVQYAPRQLGLTEPRIYISDLLA   400 . . . 401

HTQYTFEIQAVNGVTDQSPFSPQFASVNITTNQAAPSAVSIMHQVSRTVD   450
||||||||||||||||||||||||||||||||||||||||||||||||||   401
HTQYTFEIQAVNGVTDQSPFSPQFASVNITTNQAAPSAVSIMHQVSRTVD   450 . . . 451

SITLSWSQPDQPNGVILDYELQYYEK   476
|||||||||||||||||||||||||   451
SITLSWSQPDQPNGVILDYELQYYEK   476
```

Sequence name: /tmp/rmnzuDbot6/GiHbjeU8iR: EPB2_HUMAN (SEQ ID NO:245)

Sequence documentation:

Alignment of: M85491_PEA.sub.--1_P14 (SEQ ID NO:247).times.EPB2_HUMAN (SEQ ID NO:245).

Alignment segment 1/1: TABLE-US-00484 Quality: 2673.00 Escore: 0 Matching length: 270 Total length: 270 Matching Percent 100.00 Matching Percent Identity: 100.00 Similarity: Total Percent Similarity: 100.00 Total Percent Identity: 100.00 Gaps: 0

Expression of Ephrin Type-B Receptor 2 Precursor (EC 2.7.1.112) (Tyrosine-Protein Kinase Receptor EPH-3) M85491 Transcripts which are Detectable by Amplicon as Depicted in Sequence Name M85491seg24 (SEQ ID NO:866) in Normal and Cancerous Breast Tissues Expression of Ephrin type-B receptor 2 precursor (EC 2.7.1.112) (Tyrosine-protein kinase receptor EPH-3) transcripts detectable by or according to seg24, M85491seg24 (SEQ ID NO:866) amplicon and M85491seg24F (SEQ ID NO:864) M85491seg24R (SEQ ID NO:8656) primers was

```
Alignment: TABLE-US-00485 . . . 1
MALRRLGAALLLLPLLAAVEETLMDSTTATAELGWMVHPPSGWEEVSGYD   50
||||||||||||||||||||||||||||||||||||||||||||||||||   1
MALRRLGAALLLLPLLAAVEETLMDSTTATAELGWMVHPPSGWEEVSGYD   50 . . . 51

ENMNTIRTYQVCNVFESSQNNWLRTKFIRRRGAHRIHVEMKFSVRDCSSI   100
||||||||||||||||||||||||||||||||||||||||||||||||||   51
ENMNTIRTYQVCNVFESSQNNWLRTKFIRRRGAHRIHVEMKFSVRDCSSI   100 . . . 101

PSVPGSCKETFNLYYYEADFDSATKTFPNWMENPWVKVDTIAADESFSQV   150
||||||||||||||||||||||||||||||||||||||||||||||||||   101
PSVPGSCKETFNLYYYEADFDSATKTFPNWMENPWVKVDTIAADESFSQV   150 . . . 151

DLGGRVMKINTEVRSFGPVSRSGFYLAFQDYGGCMSLIAVRVFYRKCPRI   200
||||||||||||||||||||||||||||||||||||||||||||||||||   151
DLGGRVMKINTEVRSFGPVSRSGFYLAFQDYGGCMSLIAVRVFYRKCPRI   200 . . . 201

IQNGAIFQETLSGAESTSLVAARGSCIANAEEVDVPIKLYCNGDGEWLVP   250
||||||||||||||||||||||||||||||||||||||||||||||||||   201
IQNGAIFQETLSGAESTSLVAARGSCIANAEEVDVPIKLYCNGDGEWLVP   250 . . . 251

IGRCMCKAGFEAVENGTVCR   270
|||||||||||||||||||   251
IGRCMCKAGFEAVENGTVCR   270
``` measured by real time PCR. In parallel the expression of four housekeeping genes—PBGD (GenBank Accession No. BC019323 (SEQ ID NO:926); amplicon-PBGD-amplicon (SEQ ID NO:929)), HPRT1 (GenBank Accession No. NM.sub.--000194 (SEQ ID NO:930); amplican-HPRT1-amplicon (SEQ ID NO:933)), SDHA (GenBank Accession No. NM.sub.--004168 (SEQ ID NO:922); amplican-SDHA-amplicon (SEQ ID NO:925)), and G6PD (GenBank Accession No. NM.sub.--000402 (SEQ ID NO:918); G6PD-amplicon (SEQ ID NO:921)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 1, above, "Tissue samples in testing panel"), to obtain a value of fold up-regulation for each sample relative to median of the normal PM samples.

Figure 26:
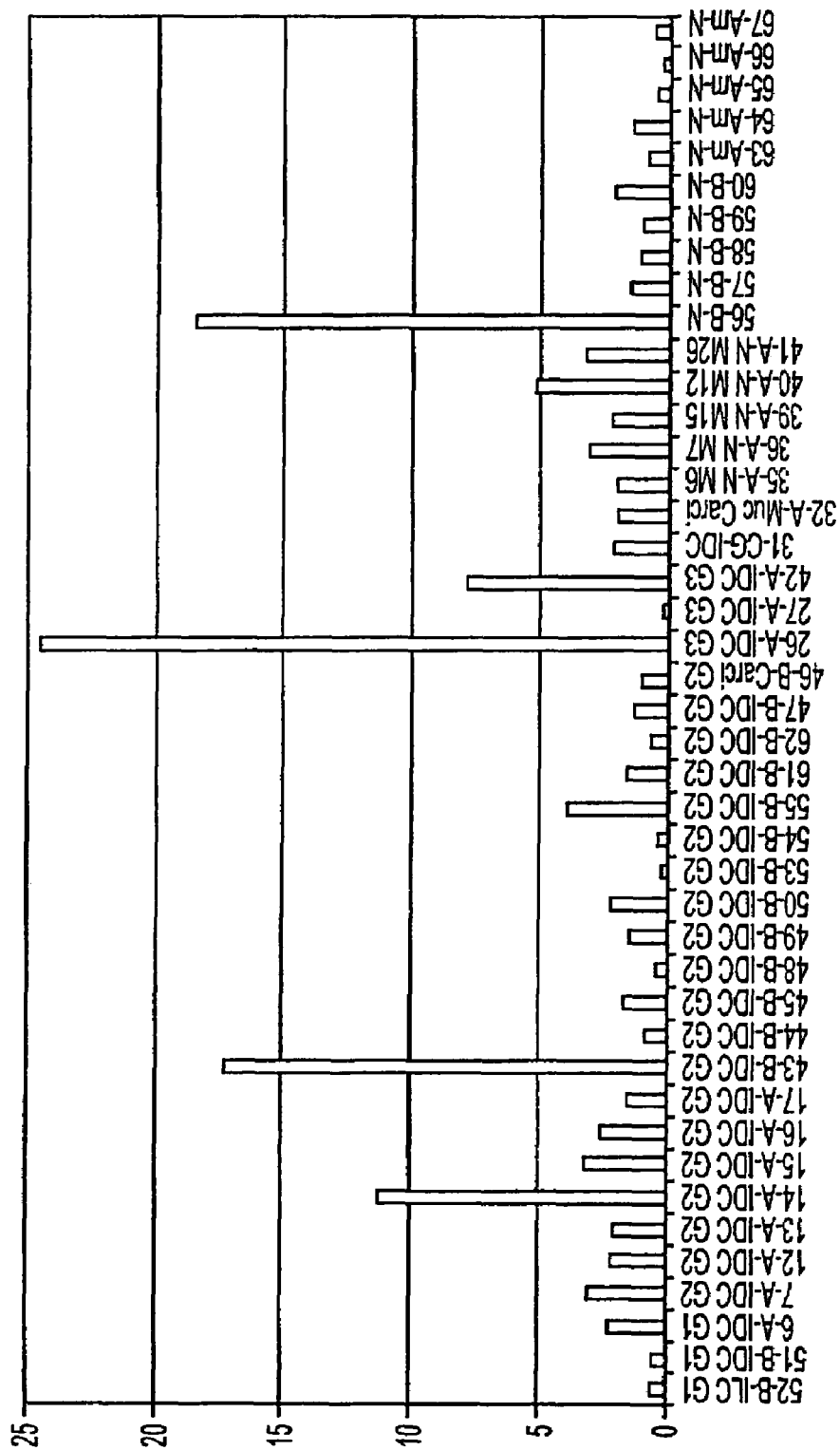
FIG. 26 is a histogram showing the expression of Ephrin type-B receptor 2 precursor (EC 2.7.1.112) (Tyrosine-protein kinase receptor EPH-3) M85491 transcripts which are detectable by amplicon as depicted in sequence name M85491seg24 (SEQ ID NO:866) in normal and cancerous breast tissues.

FIG. 26 is a histogram showing over expression of the above-indicated Ephrin type-B receptor 2 precursor (EC 2.7.1.112) (Tyrosine-protein kinase receptor EPH-3) transcripts in cancerous breast samples relative to the normal samples.

As is evident from FIG. 26, the expression of Ephrin type-B receptor 2 precursor (EC 2.7.1.112) (Tyrosine-protein kinase receptor EPH-3) transcripts detectable by the above amplicon in a few cancer samples was higher than in the non-cancerous samples (Sample Nos. 56-60, 63-67, Table 1, above, "Tissue samples in testing panel").

Primer pairs are also optionally and preferably encompassed within the present invention; for example, for the above experiment, the following primer pair was used as a non-limiting illustrative example only of a suitable primer pair: M85491seg24F (SEQ ID NO:864) forward primer; and M85491seg24R (SEQ ID NO:865) reverse primer.

The present invention also preferably encompasses any amplicon obtained through the use of any suitable primer pair; for example, for the above experiment, the following amplicon was obtained as a non-limiting illustrative example only of a suitable amplicon: M85491 seg24 (SEQ ID NO:866). TABLE-US-00486 M85491seg24 Forward primer (SEQ ID NO:864): GGCGTCTTTCTCCCTCTGAAC M85491seg24 Reverse primer (SEQ ID NO:865): GTC-CCATTCTGGGTGCTGTG M85491seg24 Amplicon (SEQ ID NO:866): GGCGTCTTTCTCCCTCTGAACCT-CAGTTTCCACCTGTGTCGAGTGTGGGT GAGAC-CCCTCGCGGGGAGCTATGCAGGTTACG-GAGAAAAGGCAGCACAGC ACCCAGAATGGGAC Expression of Ephrin Type-B Receptor 2 Precursor M85491 Transcripts, which are Detectable by Amplicon as Depicted in Sequence Name M85491 seg24 (SEQ ID NO:866) in Different Normal Tissues Expression of Ephrin type-B receptor 2 precursor transcripts detectable by or according to M85491 seg24 amplicon(s) (SEQ ID NO:866) and M85491 seg24F (SEQ ID NO:864) and M85491 seg24R (SEQ ID NO:865) priemrs was measured by real time PCR. In parallel the expression of four housekeeping genes—RPL 19 (GenBank Accession No. NM.sub.--000981 (SEQ ID NO:934) RPL19 amplicon (SEQ ID NO:937)), TATA box (GenBank Accession No. NM.sub.--003194 (SEQ ID NO:938); TATA amplicon (SEQ ID NO:941)), UBC (GenBank Accession No. BC000449 (SEQ ID NO:942); amplican-Ubiquitin-amplicon (SEQ ID NO:945)) and SDHA (GenBank Accession No. NM.sub.--004168 (SEQ ID NO:922); amplican-SDHA-amplicon (SEQ ID NO:925)) was measured similarly. For each RT sample, the expression of the above amplicon was normalized to the geometric mean of the quantities of the housekeeping genes. The normalized quantity of each RT sample was then divided by the median of the quantities of the colon samples (Sample Nos. 1-3 Table 2, "Tissue samples on normal panel", above), to obtain a value of relative expression of each sample relative to median of the colon samples. Primers and amplicon are as above.

Figure 27:
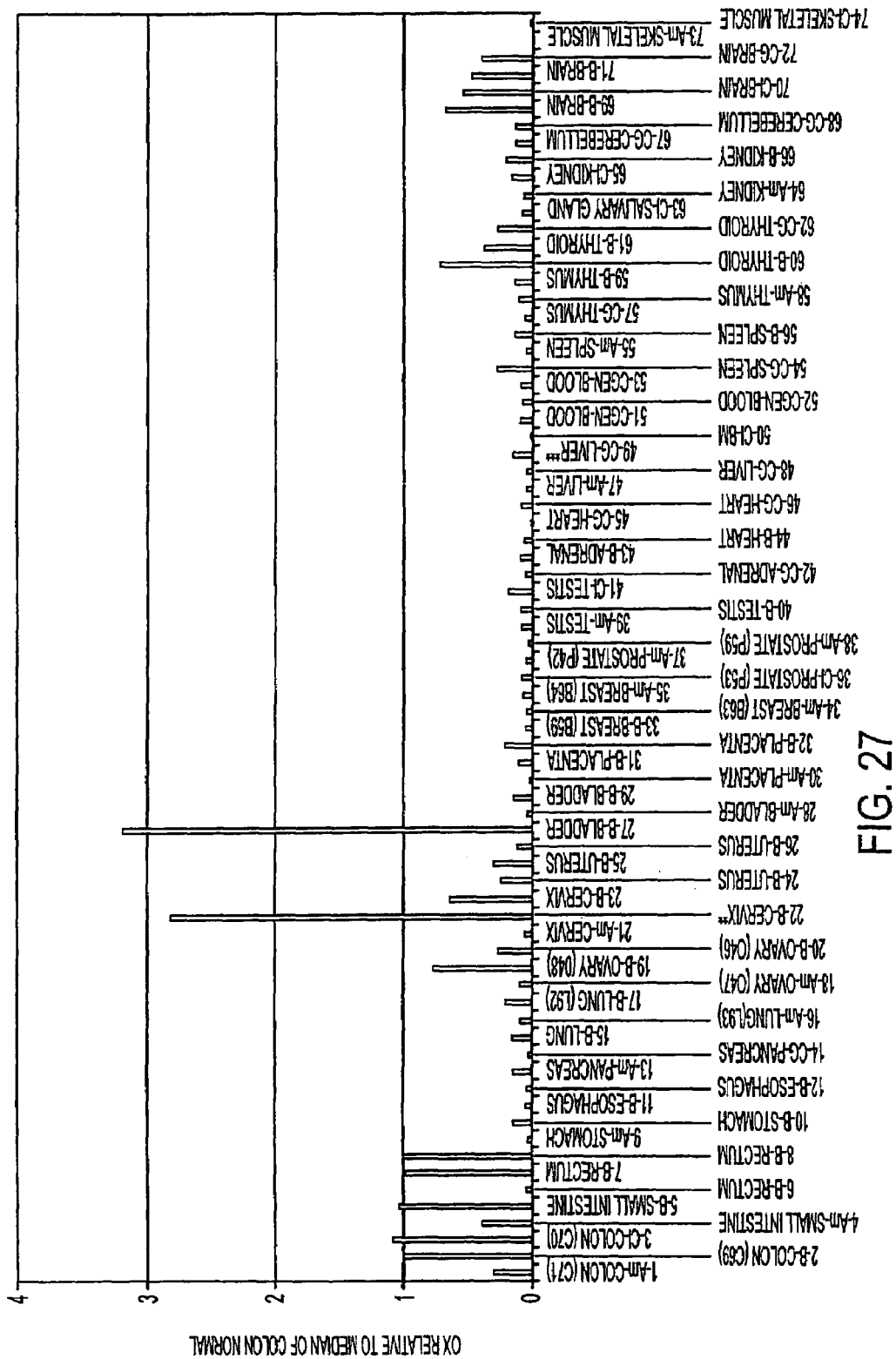
FIG. 27 is a histogram showing the expression of Ephrin type-B receptor 2 precursor M85491 transcripts,-which are detectable by amplicon as depicted in sequence name M85491 seg24, in different normal tissues.

The results are presented in FIG. 27, demonstrating the expression of Ephrin type-B receptor 2 precursor M85491 transcripts, which are detectable by amplicon as depicted in sequence name M85491 seg24 (SEQ ID NO:866), in different normal tissues.

Description for Cluster HSSTROL3

Cluster HSSTROL3 features 6 transcript(s) and 16 segment(s) of interest, the names for which are given in Tables 1 and 2, respectively, the sequences themselves are given at the end of the application. The selected protein variants are given in table 3. TABLE-US-00487 TABLE 1 Transcripts of interest Transcript Name Sequence ID No. HSSTROL3_T5 248 HSSTROL3_T8 249 HSSTROL3_T9 250 HSSTROL3_T10 251 HSSTROL3_T11 252 HSSTROL3_T12 253 [1575] TABLE-US-00488 TABLE 2 Segments of interest Segment Name Sequence ID No. HSSTROL3_node_6 254 HSSTROL3_node_10 255 HSSTROL3_node_13 256 HSSTROL3_node_15 257 HSSTROL3_node_19 258 HSSTROL3_node_21 259 HSSTROL3_node_24 260 HSSTROL3_node_25 261 HSSTROL3_node_26 262 HSSTROL3_node_28 263 HSSTROL3_node_29 264 HSSTROL3_node_11 265 HSSTROL3_node_17 266 HSSTROL3_node_18 267 HSSTROL3_node_20 268 HSSTROL3_node_27 269

TABLE-US-00489 TABLE 3 Proteins of interest Sequence Protein Name ID No. Corresponding Transcript(s) HSSTROL3_P4 271 HSSTROL3_T5 (SEQ ID NO:248) HSSTROL3_P5 272 HSSTROL3_T8 (SEQ ID NO:249); HSSTROL3_T9 (SEQ ID NO:250) HSSTROL3_P7 273 HSSTROL3_T10 (SEQ ID NO:251) HSSTROL3_P8 274 HSSTROL3_T11 (SEQ ID NO:252) HSSTROL3_P9 275 HSSTROL3_T12 (SEQ ID NO:253)

These sequences are variants of the known protein Stromelysin-3 precursor (SEQ ID NO:270) (SwissProt accession identifier MM11_HUMAN; known also according to the synonyms EC 3.4.24.-; Matrix metalloproteinase-11; MMP-11; ST3; SL-3), SEQ ID NO: 270, referred to herein as the previously known protein.

Protein Stromelysin-3 precursor (SEQ ID NO:270) is known or believed to have the following function(s): May play an important role in the progression of epithelial malignancies. The sequence for protein Stromelysin-3 precursor (SEQ ID NO:270) is given at the end of the application, as "Stromelysin-3 precursor (SEQ ID NO:270) amino acid sequence".

The following GO Annotation(s) apply to the previously known protein. The following annotation(s) were found: proteolysis and peptidolysis; developmental processes; morphogenesis, which are annotation(s) related to Biological Process; stromelysin 3; calcium binding; zinc binding; hydrolase, which are annotation(s) related to Molecular Function; and extracellular matrix, which are annotation(s) related to Cellular Component.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster HSSTROL3 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 28 refer to weighted expression of ESTs in each category, as "parts per million" (ratio of the expression of ESTs for a particular cluster to the expression of all ESTs in that category, according to parts per million).

Figure 28:
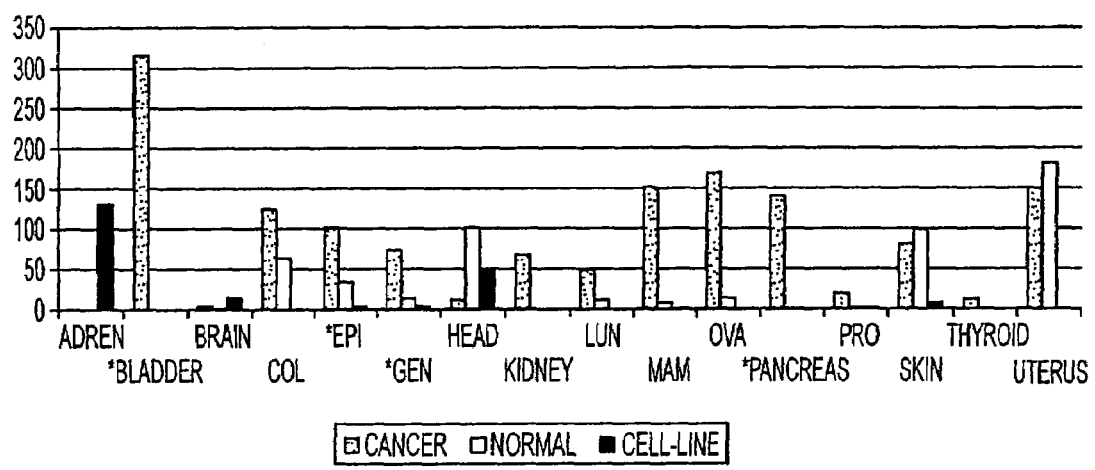
FIG. 28 is a histogram showing Cancer and cell-line vs. normal tissue expression for Cluster HSSTROL3, demonstrating overexpression in transitional cell carcinoma, epithelial malignant tumors, a mixture of malignant tumors from different tissues and pancreas carcinoma.

Overall, the following results were obtained as shown with regard to the histograms in FIG. 28 and Table 4. This cluster is overexpressed (at least at a minimum level) in the following pathological conditions: transitional cell carcinoma, epithelial malignant tumors, a mixture of malignant tumors from different tissues and pancreas carcinoma. TABLE-US-00490 TABLE 4 Normal tissue distribution Name of Tissue Number Adrenal 0 Bladder 0 Brain 1 Colon 63 Epithelial 33 General 13 head and neck 101 Kidney 0 lung 11 breast 8 ovary 14 pancreas 0 prostate 2 skin 99 Thyroid 0 uterus 181

TABLE-US-00491 TABLE 5 P values and ratios for expression in cancerous tissue Name of Tissue P1 P2 SP1 R3 SP2 R4 adrenal 1 4.6e-01 11.0 5.3e-01 1.9 bladder 2.7e-01 3.4e-01 3.3e-03 4.9 2.1e-02 3.3 brain 3.5e-01 2.6e-01 11.7 3.3e-01 2.8 colon 7.7e-02 1.5e-01 3.1e-01 1.4 5.2e-01 1.0 epithelial 1.2e-04 1.2e-02 1.3e-06 2.7 4.6e-02 1.4 general 5.4e-09 3.1e-05 1.8e-16 5.0 3.1e-07 2.6 head and neck 4.6e-01 4.3e-01 10.6 9.4e-01 0.7 kidney 2.5e-01 3.5e-01 1.1e-01 4.0 2.4e-01 2.8 lung 1.8e-01 4.5e-01 1.9e-01 2.7 5.1e-01 1.4 breast 2.0e-01 3.4e-01 7.3e-02 3.3 2.5e-01 2.0 ovary 2.6e-01 3.2e-01 2.2e-02 2.0 7.0e-02 1.6 pancreas 9.5e-02 1.8e-01 1.8e-04 7.8 1.6e-03 5.5 prostate 8.2e-01 7.8e-01 4.5e-01 1.8 5.6e-01 1.5 skin 5.2e-01 5.8e-01 7.1e-01 0.8 1 0.3 Thyroid 2.9e-01 2.9e-01 11.1 11.1 uterus 4.2e-01 8.0e-01 7.5e-01 0.6 9.9e-01 0.4

As noted above, cluster HSSTROL3 features 6 transcript(s), which were listed in Table 1 above. These transcript(s) encode for protein(s) which are variant(s) of protein Stromelysin-3 precursor (SEQ ID NO:270). A description of each variant protein according to the present invention is now provided.

Variant protein HSSTROL3_P4 (SEQ ID NO:271) according to the present invention has an amino acid sequence as given at the end of the application; it is encoded by transcript(s) HSSTROL3_T5 (SEQ ID NO:248). An alignment is given to the known protein (Stromelysin-3 precursor (SEQ ID NO:270)) at the end of the application. One or more alignments to one or more previously published protein sequences are given at the end of the application. A brief description of the relationship of the variant protein according to the present invention to each such aligned protein is as follows:

Comparison report between HSSTROL3_P4 (SEQ ID NO:271) and MM11_HUMAN (SEQ ID NO:270):

1. An isolated chimeric polypeptide encoding for HSSTROL3_P4 (SEQ ID NO:271), comprising a first amino acid sequence being at least 90% homologous to MAPAAWLRSAAARALLPPMLLLLLQPP- PLLARALPPDVHHLHAERRGPQPWHAALPSS PAPAP- ATQEAPRPASSLRPPRCGVPDPSDGL- SARNRQKRFVLSGGRWEKTDLTYRILRFP WQLVQEQVRQTMAEALKVWSDVTPLT- FTEVHEGRADIMIDFARYW corresponding to amino acids 1-163 of MM11_HUMAN (SEQ ID NO:270), which also corresponds to amino acids 1-163 of HSSTROL3_P4 (SEQ ID NO:271), a bridging amino acid H corresponding to amino acid 164 of HSSTROL3_P4 (SEQ ID NO:271), a second amino acid sequence being at least 90% homologous to GDDLPFDGPGGILAHAFFPKTHREGDVH- FDYDETWTIGDDQGTDLLQVAAHEFGHVLG LQHT- TAAKALMSAFYTFRYPLSLSPD- DCRGVQHLYGQPWPTVTSRTPALGPQAGIDTN EIAPLEPDAPPDACEASFDAVSTIRGEL- FFFKAGFVWRLRGGQLQPGYPALASRHWQGL PSPVDMFEDAQGHIWFFQGAQY- WVYDGEKPVLGPAPLTELGLVRFPVHAALVWGPE KNKIYFFRGRDYWRFHPSTRRVD- SPVPRRATDWRGVPSEIDAAFQDADG corresponding to amino acids 165-445 of MM11_HUMAN (SEQ ID NO:270), which also corresponds to amino acids 165-445 of HSSTROL3_P4 (SEQ ID NO:271), and a third amino acid sequence being at least 70%, optionally at least 80%, preferably at least 85%, more preferably at least 90% and most preferably at least 95% homologous to a polypeptide having the sequence ALGVRQLVGGGHSSRFSHLWAGL- PHACHRKSGSSSQVLCPEPSALLSVAG (SEQ ID NO:966) corresponding to amino acids 446-496 of HSSTROL3_P4 (SEQ ID NO:271), wherein said first amino acid sequence, bridging amino acid, second amino acid sequence and third amino acid sequence are contiguous and in a sequential order.

2. An isolated polypeptide encoding for a tail of HSSTROL3_P4 (SEQ ID NO:271), comprising a polypeptide being at least 70%, optionally at least about 80%, preferably at least about 85%, more preferably at least about 90% and most preferably at least about 95% homologous to the sequence TABLE-US-00492 (SEQ ID NO:966) ALGVRQLVGGGHSSRFSHLWAGL- PHACHRKSGSSSQVLCPEPSALLSVA G in (SEQ ID NO:271) HSSTROL3_P4.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P4 (SEQ ID NO:271) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein HSSTROL3_P4 (SEQ ID NO:271) sequence provides support for the deduced sequence of this variant protein according to the present invention). TABLE-US-00493 TABLE 6 Amino acid mutations SNP position(s) on amino Previously known acid sequence Alternative amino acid(s) SNP? 38 V→A Yes 104 R→P Yes 214 A→No 323 Q→H Yes Variant protein HSSTROL3_P4 (SEQ ID NO:271) is encoded by the following transcript(s): HSSTROL3_T5 (SEQ ID NO:248), for which the sequence(s) is/are given at the end of the application. The coding portion of transcript HSSTROL3_T5 (SEQ ID NO:248) is shown in bold; this coding portion starts at position 24 and ends at position 1511. The transcript also has the following SNPs as listed in Table 7 (given according to their position on the nucleotide sequence, with the alternative nucleic acid listed; the last column indicates whether the SNP is known or not; the presence of known SNPs in variant protein HSSTROL3_P4 (SEQ ID NO:271) sequence provides support for the deduced sequence of this variant protein according to the present invention). TABLE-US-00494 TABLE 7 Nucleic acid SNPs SNP position on nucleotide Previously known sequence Alternative nucleic acid SNP? 136 T→C Yes 334 G→C Yes 663 G→No 699→T No 992 G→C Yes 1528 A→G Yes 1710A→G Yes 2251 A→G Yes 2392 C→No 2444 C→A Yes 2470 A→T Yes 2687→G No 2696→G No 2710 C→No 2729→A No 2755 T→C No 2813 A→No 2813 A→C No 2963 A→No 2963 A→C No 2993 T→C Yes 3140→T No Variant protein HSSTROL3_P5 (SEQ ID NO:272) according to the present invention has an amino acid sequence as given at the end of the application; it is encoded by transcript(s) HSSTROL3_T8 (SEQ ID NO:249) and HSSTROL3_T9 (SEQ ID NO:250). An alignment is given to the known protein (Stromelysin-3 precursor (SEQ ID NO:270)) at the end of the application. One or more alignments to one or more previously published protein sequences are given at the end of the application. A brief description of the relationship of the variant protein according to the present invention to each such aligned protein is as follows:

Comparison report between HSSTROL3_P5 (SEQ ID NO:272) and MM11_HUMAN (SEQ ID NO:270):

1. An isolated chimeric polypeptide encoding for HSSTROL3_P5 (SEQ ID NO:272), comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDPSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:270), which also corresponds to amino acids 1-163 of HSSTROL3_P5 (SEQ ID NO:272), a bridging amino acid H corresponding to amino acid 164 of HSSTROL3_P5 (SEQ ID NO:272), a second amino acid sequence being at least 90% homologous to GDDLPFDGPGGILAHAFFPKTHREGDVH-FDYDETWTIGDDQGTDLLQVAAHEFGHVLG LQHT-TAAKALMSAFYTFRYPLSLSPD-DCRGVQHLYGQPWPTVTSRTPALGPQAGIDTN EIAPLEPDAPPDACEASFDAVSTIRGEL-FFFKAGFVWRLRGGQLQPGYPALASRHWQGL PSPVDAAFEDAQGHIWFFQ corresponding to amino acids 165-358 of MM11_HUMAN (SEQ ID NO:270), which also corresponds to amino acids 165-358 of HSSTROL3_P5 (SEQ ID NO:272), and a third amino acid sequence being at least 70%, optionally at least 80%, preferably at least 85%, more preferably at least 90% and most preferably at least 95% homologous to a polypeptide having the sequence ELGF-PSSTGRDESLEHCRCQGLHK (SEQ ID NO:967) corresponding to amino acids 359-382 of HSSTROL3_P5 (SEQ ID NO:272), wherein said first amino acid sequence, bridging amino acid, second amino acid sequence and third amino acid sequence are contiguous and in a sequential order.

2. An isolated polypeptide encoding for a tail of HSSTROL3_P5 (SEQ ID NO:272), comprising a polypeptide being at least 70%, optionally at least about 80%, preferably at least about 85%, more preferably at least about 90% and most preferably at least about 95% homologous to the sequence ELGFPSSTGRDESLEHCRCQGLHK (SEQ ID NO:967) in HSSTROL3_P5 (SEQ ID NO:272).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P5 (SEQ ID NO:272) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein HSSTROL3_P5 (SEQ ID NO:272) sequence provides support for the deduced sequence of this variant protein according to the present invention). TABLE-US-00495 TABLE 8 Amino acid mutations SNP position(s) on amino Previously known acid sequence Alternative amino acid(s) SNP? 38 V→A Yes 104 R→P Yes 214 A→No 323 Q→H Yes Variant protein HSSTROL3_P5 (SEQ ID NO:272) is encoded by the following transcript(s): HSSTROL3_T8 (SEQ ID NO:249) and HSSTROL3_T9 (SEQ ID NO:250), for which the sequence(s) is/are given at the end of the application.

The coding portion of transcript HSSTROL3_T8 (SEQ ID NO:249) is shown in bold; this coding portion starts at position 24 and ends at position 1169. The transcript also has the following SNPs as listed in Table 9 (given according to their position on the nucleotide sequence, with the alternative nucleic acid listed; the last column indicates whether the SNP is known or not; the presence of known SNPs in variant protein HSSTROL3_P5 (SEQ ID NO:272) sequence provides support for the deduced sequence of this variant protein according to the present invention). TABLE-US-00496 TABLE 9 Nucleic acid SNPs SNP position on nucleotide Alternative Previously known sequence nucleic acid SNP? 136 T→C Yes 334 G→C Yes 663 G→No 699→T No 992 G→C Yes 1903 C→No 1955 C→A Yes 1981 A→T Yes 2198→G No 2207→G No 2221 C→No 2240→A No 2266 T→C No 2324 A→No 2324 A→C No 2474 A→No 2474 A→C No 2504 T→C Yes 2651→T No The coding portion of transcript HSSTROL3_T9 (SEQ ID NO:250) is shown in bold; this coding portion starts at position 24 and ends at position 1169. The transcript also has the following SNPs as listed in Table 10 (given according to their position on the nucleotide sequence, with the alternative nucleic acid listed; the last column indicates whether the SNP is known or not; the presence of known SNPs in variant protein HSSTROL3_P5 (SEQ ID NO:272) sequence provides support for the deduced sequence of this variant protein according to the present invention). TABLE-US-00497 TABLE 10 Nucleic acid SNPs SNP position on nucleotide Alternative Previously known sequence nucleic acid SNP? 136 T→C Yes 334 G→C Yes 663 G→No 699→T No 992 G→C Yes 1666 A→G Yes 1848A→G Yes 2389 A→G Yes 2530 C→No 2582 C→A Yes 2608 A→T Yes 2825→G No 2834→G No 2848 C→No 2867→A No 2893 T→C No 2951 A→No 2951 A→C No 3101 A→No 3101 A→C No 3131 T→C Yes 3278→T No Variant protein HSSTROL3_P7 (SEQ ID NO:273) according to the present invention has an amino acid sequence as given at the end of the application; it is encoded by transcript(s) HSSTROL3_T10 (SEQ ID NO:251). An alignment is given to the known protein (Stromelysin-3 precursor (SEQ ID NO:270)) at the end of the application. One or more alignments to one or more previously published protein sequences are given at the end of the application. A brief description of the relationship of the variant protein according to the present invention to each such aligned protein is as follows:

Comparison report between HSSTROL3_P7 (SEQ ID NO:273) and MM11_HUMAN (SEQ ID NO:270):

1. An isolated chimeric polypeptide encoding for HSSTROL3_P7 (SEQ ID NO:273), comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDPSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:270), which also corresponds to amino acids 1-163 of HSSTROL3_P7 (SEQ ID NO:273), a bridging amino acid H corresponding to amino acid 164 of HSSTROL3_P7 (SEQ ID NO:273), a second amino acid sequence being at least 90% homologous to GDDLPFDGPGGILAHAFFPKTHREGDVH-FDYDETWTIGDDQGTDLLQVAAHEFGHVLG LQHT-TAAKALMSAFYTFRYPLSLSPD-DCRGVQHLYGQPWPTVTSRTPALGPQAGIDTN EIAPLEPDAPPDACEASFDAVSTIRGEL-FFFKAGFVWRLRGGQLQPGYPALASRHWQGL PSPVDAAFEDAQGHIWFFQ corresponding to amino acids 165-359 of MM11_HUMAN (SEQ ID NO:270), which also corresponds to amino acids 165-359 of HSSTROL3_P7 (SEQ ID NO:273), and a third amino acid sequence being at least 70%, optionally at least 80%, preferably at least 85%, more preferably at least 90% and most preferably at least 95% homologous to a polypeptide having the sequence TTGVST-PAPGV (SEQ ID NO:968) corresponding to amino acids 360-370 of HSSTROL3_P7 (SEQ ID NO:273), wherein said first amino acid sequence, bridging amino acid, second amino acid sequence and third amino acid sequence are contiguous and in a sequential order.

2. An isolated polypeptide encoding for a tail of HSSTROL3_P7 (SEQ ID NO:273), comprising a polypeptide being at least 70%, optionally at least about 80%, preferably at least about 85%, more preferably at least about 90% and most preferably at least about 95% homologous to the sequence TTGVSTPAPGV (SEQ ID NO:968) in HSSTROL3_P7 (SEQ ID NO:273).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P7 (SEQ ID NO:273) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein HSSTROL3_P7 (SEQ ID NO:273) sequence provides support for the deduced sequence of this variant protein according to the present invention). TABLE-US-00498 TABLE 11 Amino acid mutations SNP position(s) on Alternative Previously known amino acid sequence amino acid(s) SNP? 38 V→A Yes 104 R→P Yes 214 A→No 323 Q→H Yes Variant protein HSSTROL3_P7 (SEQ ID NO:273) is encoded by the following transcript(s): HSSTROL3_T10 (SEQ ID NO:251), for which the sequence(s) is/are given at the end of the application. The coding portion of transcript HSSTROL3_T10 (SEQ ID NO:251) is shown in bold; this coding portion starts at position 24 and ends at position 1133. The transcript also has the following SNPs as listed in Table 12 (given according to their position on the nucleotide sequence, with the alternative nucleic acid listed; the last column indicates whether the SNP is known or not; the presence of known SNPs in variant protein HSSTROL3_P7 (SEQ ID NO:273) sequence provides support for the deduced sequence of this variant protein according to the present invention). TABLE-US-00499 TABLE 12 Nucleic acid SNPs SNP position on nucleotide Alternative Previously known sequence nucleic acid SNP? 136 T→C Yes 334 G→C Yes 663 G→No 699→T No 992 G→C Yes 1386 A→G Yes 1568 A→G Yes 2109 A→G Yes 2250 C→No 2302 C→A Yes 2328 A→T Yes 2545→G No 2554→G No 2568 C→No 2587→A No 2613 T→C No 2671 A→No 2671 A→C No 2821 A→No 2821 A→C No 2851 T→C Yes 2998→T No Variant protein HSSTROL3_P8 (SEQ ID NO:274) according to the present invention has an amino acid sequence as given at the end of the application; it is encoded by transcript(s) HSSTROL3_T11 (SEQ ID NO:252). An alignment is given to the known protein (Stromelysin-3 precursor (SEQ ID NO:270)) at the end of the application. One or more alignments to one or more previously published protein sequences are given at the end of the application. A brief description of the relationship of the variant protein according to the present invention to each such aligned protein is as follows:

Comparison report between HSSTROL3_P8 (SEQ ID NO:274) and MM11_HUMAN (SEQ ID NO:270):

1. An isolated chimeric polypeptide encoding for HSSTROL3_P8 (SEQ ID NO:274), comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDPSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:270), which also corresponds to amino acids 1-163 of HSSTROL3_P8 (SEQ ID NO:274), a bridging amino acid H corresponding to amino acid 164 of HSSTROL3_P8 (SEQ ID NO:274), a second amino acid sequence being at least 90% homologous to GDDLPFDGPGGILAHAFFPKTHREGDVH-FDYDETWTIGDDQGTDLLQVAAHEFGHVLG LQHT-TAAKALMSAFYTFRYPLSLSPD-DCRGVQHLYGQPWPTVTSRTPALGPQAGIDTN EIAPLE corresponding to amino acids 165-286 of MM11_HUMAN (SEQ ID NO:270), which also corresponds to amino acids 165-286 of HSSTROL3_P8 (SEQ ID NO:274), and a third amino acid sequence being at least 70%, optionally at least 80%, preferably at least 85%, more preferably at least 90% and most preferably at least 95% homologous to a polypeptide having the sequence VRPCLPV-PLLLCWPL (SEQ ID NO:969) corresponding to amino acids 287-301 of HSSTROL3_P8 (SEQ ID NO:274), wherein said first amino acid sequence, bridging amino acid, second amino acid sequence and third amino acid sequence are contiguous and in a sequential order.

2. An isolated polypeptide encoding for a tail of HSSTROL3_P8 (SEQ ID NO:274), comprising a polypeptide being at least 70%, optionally at least about 80%, preferably at least about 85%, more preferably at least about 90% and most preferably at least about 95% homologous to the sequence VRPCLPVPLLLCWPL (SEQ ID NO:969) in HSSTROL3_P8 (SEQ ID NO:274).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P8 (SEQ ID NO:274) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein HSSTROL3_P8 (SEQ ID NO:274) sequence provides support for the deduced sequence of this variant protein according to the present invention). TABLE-US-00500 TABLE 13 Amino acid mutations SNP position(s) on Alternative Previously known amino acid sequence amino acid(s) SNP? 38 V→A Yes 104 R→P Yes 214 A→No Variant protein HSSTROL3_P8 (SEQ ID NO:274) is encoded by the following transcript(s): HSSTROL3_T11 (SEQ ID NO:252), for which the sequence(s) is/are given at the end of the application. The coding portion of transcript HSSTROL3_T11 (SEQ ID NO:252) is shown in bold; this coding portion starts at position 24 and ends at position 926. The transcript also has the following SNPs as listed in Table 14 (given according to their position on the nucleotide sequence, with the alternative nucleic acid listed; the last column indicates whether the SNP is known or not; the presence of known SNPs in variant protein HSSTROL3_P8 (SEQ ID NO:274) sequence provides support for the deduced sequence of this variant protein according to the present invention). TABLE-US-00501 TABLE 14 Nucleic acid SNPs SNP position on nucleotide Alternative Previously known sequence nucleic acid SNP? 136 T→C Yes 334 G→C Yes 663 G→No 699→T No 935 G→A Yes 948 G→A Yes 1084 G→C Yes 1557 C→No 1609 C→A Yes 1635 A→T Yes 1852→G No 1861→G No 1875 C→No 1894→A No 1920 T→C No 1978A→No 1978A→C No 2128A→No 2128A→C No 2158 T→C Yes 2305→T No Variant protein HSSTROL3_P9 (SEQ ID NO:275) according to the present invention has an amino acid sequence as given at the end of the application; it is encoded by transcript(s) HSSTROL3_T12 (SEQ ID NO:253). An alignment is given to the known protein (Stromelysin-3 precursor (SEQ ID NO:270)) at the end of the application. One or more alignments to one or more previously published protein sequences are given at the end of the application. A brief description of the relationship of the variant protein according to the present invention to each such aligned protein is as follows:

Comparison report between HSSTROL3_P9 (SEQ ID NO:275) and MM11_HUMAN (SEQ ID NO:270):

1. An isolated chimeric polypeptide encoding for HSSTROL3_P9 (SEQ ID NO:275), comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDPSDGLSARNRQK corresponding to amino acids 1-96 of MM11_HUMAN (SEQ ID NO:270), which also corresponds to amino acids 1-96 of HSSTROL3_P9 (SEQ ID NO:275), a second amino acid sequence being at least 90% homologous to RILRFP-WQLVQEQVRQTMAEALKVWSDVTPLT-FTEVHEGRADIMIDFARYW corresponding to amino acids 113-163 of MM11_HUMAN (SEQ ID NO:270), which also corresponds to amino acids 97-147 of HSSTROL3_P9 (SEQ ID NO:275), a bridging amino acid H corresponding to amino acid 148 of HSSTROL3_P9 (SEQ ID NO:275), a third amino acid sequence being at least 90% homologous to GDDLPFDGPGGILAHAFFPKTHREGDVH-FDYDETWTIGDDQGTDLLQVAAHEFGHVLG LQHT-TAAKALMSAFYTFRYPLSLSPD-DCRGVQHLYGQPWPTVTSRTPALGPQAGIDTN EIAPLEPDAPPDACEASFDAVSTIRGEL-FFFKAGFVWRLRGGQLQPGYPALASRHWQGL PSPVDAAFEDAQGHIWFFQ corresponding to amino acids 165-359 of MM11_HUMAN (SEQ ID NO:270), which also corresponds to amino acids 149-343 of HSSTROL3_P9 (SEQ ID NO:275), and a fourth amino acid sequence being at least 70%, optionally at least 80%, preferably at least 85%, more preferably at least 90% and most preferably at least 95% homologous to a polypeptide having the sequence TTGVST-PAPGV (SEQ ID NO:968) corresponding to amino acids 344-354 of HSSTROL3_P9 (SEQ ID NO:275), wherein said first amino acid sequence, second amino acid sequence, bridging amino acid, third amino acid sequence and fourth amino acid sequence are contiguous and in a sequential order.

2. An isolated chimeric polypeptide encoding for an edge portion of HSSTROL3_P9 (SEQ ID NO:275), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KR, having a structure as follows: a sequence starting from any of amino acid numbers 96-x to 96; and ending at any of amino acid numbers 97+((n-2)-x), in which x varies from 0 to n-2.

3. An isolated polypeptide encoding for a tail of HSSTROL3_P9 (SEQ ID NO:275), comprising a polypeptide being at least 70%, optionally at least about 80%, preferably at least about 85%, more preferably at least about 90% and most preferably at least about 95% homologous to the sequence TTGVSTPAPGV (SEQ ID NO:968) in HSSTROL3_P9 (SEQ ID NO:275).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P9 (SEQ ID NO:275) also has the following non-silent SNPs (Single Nucleotide Polymorphisms) as listed in Table 15, (given according to their position(s) on the amino acid sequence, with the alternative amino acid(s) listed; the last column indicates whether the SNP is known or not; the presence of known SNPs in variant protein HSSTROL3_P9 (SEQ ID NO:275) sequence provides support for the deduced sequence of this variant protein according to the present invention). TABLE-US-00502 TABLE 15 Amino acid mutations SNP position(s) on Alternative Previously known amino acid sequence amino acid(s) SNP? 38 V→A Yes 198 A→No 307 Q→H Yes Variant protein HSSTROL3_P9 (SEQ ID NO:275) is encoded by the following transcript(s): HSSTROL3_T12 (SEQ ID NO:253), for which the sequence(s) is/are given at the end of the application. The coding portion of transcript HSSTROL3_T12 (SEQ ID NO:253) is shown in bold; this coding portion starts at position 24 and ends at position 1085. The transcript also has the following SNPs as listed in Table 16 (given according to their position on the nucleotide sequence, with the alternative nucleic acid listed; the last column indicates whether the SNP is known or not; the presence of known SNPs in variant protein HSSTROL3_P9 (SEQ ID NO:275) sequence provides support for the deduced sequence of this variant protein according to the present invention). TABLE-US-00503 TABLE 16 Nucleic acid SNPs SNP position on nucleotide Alternative Previously known sequence nucleic acid SNP? 136 T→C Yes 615 G→No 651→T No 944 G→C Yes 1275 C→No 1327 C→A Yes 1353 A→T Yes 1570→G No 1579→G No 1593 C→No 1612→A No 1638 T→C No 1696 A→No 1696 A→C No 1846 A→No 1846 A→C No 1876 T→C Yes 2023→T No As noted above, cluster HSSTROL3 features 16 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSSTROL3_node.sub.--6 (SEQ ID NO:254) according to the present invention is supported by 14 libraries. The number of libraries was determined as previously described. This segment can be found in the following transcript(s): HSSTROL3_T5 (SEQ ID NO:248), HSSTROL3_T8 (SEQ ID NO:249), HSSTROL3_T9 (SEQ ID NO:250), HSSTROL3_T10 (SEQ ID NO:251), HSSTROL3_T11 (SEQ ID NO:252) and HSSTROL3_T12 (SEQ ID NO:253). Table 17 below describes the starting and ending position of this segment on each transcript. TABLE-US-00504 TABLE 17 Segment location on transcripts Segment Segment Transcript name starting position ending position HSSTROL3_T5 (SEQ ID NO:248) 1 131 HSSTROL3_T8 (SEQ ID NO:249) 1 131 HSSTROL3_T9 (SEQ ID NO:250) 1 131 HSSTROL3_T10 (SEQID NO:251) 1 131 HSSTROL3_T11 (SEQ ID NO:252) 1 131 HSSTROL3_T12 (SEQ ID NO:253) 1 131

Segment cluster HSSTROL3_node.sub.--10 (SEQ ID NO:255) according to the present invention is supported by 21 libraries. The number of libraries was determined as previously described. This segment can be found in the following transcript(s): HSSTROL3_T5 (SEQ ID NO:248), HSSTROL3_T8 (SEQ ID NO:249), HSSTROL3_T9 (SEQ ID NO:250), HSSTROL3_T10 (SEQ ID NO:251), HSSTROL3_T11 (SEQ ID NO:252) and HSSTROL3_T12 (SEQ ID NO:253). Table 18 below describes the starting and ending position of this segment on each transcript. TABLE-US-00505 TABLE 18 Segment location on transcripts Segment Segment Transcript name starting position ending position HSSTROL3_T5 (SEQ ID NO:248) 132 313 HSSTROL3_T8 (SEQ ID NO:249) 132 313 HSSTROL3_T9 (SEQ ID NO:250) 132 313 HSSTROL3_T10 (SEQ ID NO:251) 132 313 HSSTROL3_T11 (SEQ ID NO:252) 132 313 HSSTROL3_T12 (SEQ ID NO:253) 132 313

Segment cluster HSSTROL3_node.sub.--13 (SEQ ID NO:256) according to the present invention is supported by 36 libraries. The number of libraries was determined as previously described. This segment can be found in the following transcript(s): HSSTROL3_T5 (SEQ ID NO:248), HSSTROL3_T8 (SEQ ID NO:249), HSSTROL3_T9 (SEQ ID NO:250), HSSTROL3_T10 (SEQ ID NO:251), HSSTROL3_T11 (SEQ ID NO:252) and HSSTROL3_T12 (SEQ ID NO:253). Table 19 below describes the starting and ending position of this segment on each transcript. TABLE-US-00506 TABLE 19 Segment location on transcripts Segment Seguent Transcript name starting position ending position HSSTROL3_T5 (SEQ ID NO:248) 362 505 HSSTROL3_T8 (SEQ ID NO:249) 362 505 HSSTROL3_T9 (SEQ ID NO:250) 362 505 HSSTROL3_T10 (SEQ ID NO:251) 362 505 HSSTROL3_T11 (SEQ ID NO:252) 362 505 HSSTROL3_T12 (SEQ ID NO:253) 314 457

Segment cluster HSSTROL3_node.sub.--15 (SEQ ID NO:257) according to the present invention is supported by 47 libraries. The number of libraries was determined as previously described. This segment can be found in the following transcript(s): HSSTROL3_T5 (SEQ ID NO:248), HSSTROL3_T8 (SEQ ID NO:249), HSSTROL3_T9 (SEQ ID NO:250), HSSTROL3_T10 (SEQ ID NO:251), HSSTROL3_T11 (SEQ ID NO:252) and HSSTROL3_T12 (SEQ ID NO:253). Table 20 below describes the starting and ending position of this segment on each transcript. TABLE-US-00507 TABLE 20 Segment location on transcripts Segment Segment Transcript name starting position ending position HSSTROL3_T5 (SEQ ID NO:248) 506 639 HSSTROL3_T8 (SEQ ID NO:249) 506 639 HSSTROL3_T9 (SEQ ID NO:250) 506 639 HSSTROL3_T10 (SEQ ID NO:251) 506 639 HSSTROL3_T11 (SEQ ID NO:252) 506 639 HSSTROL3_T12 (SEQ ID NO:253) 458 591

Segment cluster HSSTROL3_node.sub.--19 (SEQ ID NO:258) according to the present invention is supported by 63 libraries. The number of libraries was determined as previously described. This segment can be found in the following transcript(s): HSSTROL3_T5 (SEQ ID NO:248), HSSTROL3_T8 (SEQ ID NO:249), HSSTROL3_T9 (SEQ ID NO:250), HSSTROL3_T10 (SEQ ID NO:251), HSSTROL3_T11 (SEQ ID NO:252) and HSSTROL3_T12 (SEQ ID NO:253). Table 21 below describes the starting and ending position of this segment on each transcript. TABLE-US-00508 TABLE 21 Segment location on transcripts Segment Segment Transcript name starting position ending position HSSTROL3_T5 (SEQ ID NO:248) 699 881 HSSTROL3_T8 (SEQ ID NO:249) 699 881 HSSTROL3_T9 (SEQ ID NO:250) 699 881 HSSTROL3_T10 (SEQ ID NO:251) 699 881 HSSTROL3_T11 (SEQ ID NO:252) 699 881 HSSTROL3_T12 (SEQ ID NO:253) 651 833

Segment cluster HSSTROL3_node.sub.--21 (SEQ ID NO:259) according to the present invention is supported by 61 libraries. The number of libraries was determined as previously described. This segment can be found in the following transcript(s): HSSTROL3_T5 (SEQ ID NO:248), HSSTROL3_T8 (SEQ ID NO:249), HSSTROL3_T9 (SEQ ID NO:250), HSSTROL3_T10 (SEQ ID NO:251), HSSTROL3_T11 (SEQ ID NO:252) and HSSTROL3_T12 (SEQ ID NO:253). Table 22 below describes the starting and ending position of this segment on each transcript. TABLE-US-00509 TABLE 22 Segment location on transcripts Segment Segment Transcript name starting position ending position HSSTROL3_T5 (SEQ ID NO:248) 882 1098 HSSTROL3_T8 (SEQ ID NO:249) 882 1098 HSSTROL3_T9 (SEQ ID NO:250) 882 1098 HSSTROL3_T10 (SEQ ID NO:251) 882 1098 HSSTROL3_T11 (SEQ ID NO:252) 974 1190 HSSTROL3 T12 (SEQ ID NO:253) 834 1050

Segment cluster HSSTROL3_node.sub.--24 (SEQ ID NO:260) according to the present invention is supported by 7 libraries. The number of libraries was determined as previously described. This segment can be found in the following transcript(s): HSSTROL3_T8 (SEQ ID NO:249) and HSSTROL3_T9 (SEQ ID NO:250). Table 23 below describes the starting and ending position of this segment on each transcript. TABLE-US-00510 TABLE 23 Segment location on transcripts Segment Segment Transcript name starting position ending position HSSTROL3_T8 (SEQ ID NO:249) 1099 1236 HSSTROL3_T9 (SEQ ID NO:250) 1099 1236

Segment cluster HSSTROL3_node.sub.--25 (SEQ ID NO:261) according to the present invention is supported by 13 libraries. The number of libraries was determined as previously described. This segment can be found in the following transcript(s): HSSTROL3_T8 (SEQ ID NO:249). Table 24 below describes the starting and ending position of this segment on each transcript. TABLE-US-00511 TABLE 24 Segment location on transcripts Segment Segment Transcript name starting position ending position HSSTROL3_T8 (SEQ ID NO:249) 1237 1536

Segment cluster HSSTROL3_node.sub.--26 (SEQ ID NO:262) according to the present invention is supported by 55 libraries. The number of libraries was determined as previously described. This segment can be found in the following transcript(s): HSSTROL3_T5 (SEQ ID NO:248), HSSTROL3_T8 (SEQ ID NO:249), HSSTROL3_T9 (SEQ ID NO:250) and HSSTROL3_T11 (SEQ ID NO:252). Table 25 below describes the starting and ending position of this segment on each transcript. TABLE-US-00512 TABLE 25 Segment location on transcripts Segment Segment Transcript name starting position ending position HSSTROL3_T5 (SEQ ID NO:248) 1099 1240 HSSTROL3_T8 (SEQ ID NO:249) 1537 1678 HSSTROL3_T9 (SEQ ID NO:250) 1237 1378 HSSTROL3_T11 (SEQ ID NO:252) 1191 1332

Segment cluster HSSTROL3_node.sub.--28 (SEQ ID NO:263) according to the present invention is supported by 10 libraries. The number of libraries was determined as previously described. This segment can be found in the following transcript(s): HSSTROL3_T5 (SEQ ID NO:248), HSSTROL3_T9 (SEQ ID NO:250) and HSSTROL3_T10 (SEQ ID NO:251). Table 26 below describes the starting and ending position of this segment on each transcript. TABLE-US-00513 TABLE 26 Segment location on transcripts Segment Segment Transcript name starting position ending position HSSTROL3_T5 (SEQ ID NO:248) 1357 2283 HSSTROL3_T9 (SEQ ID NO:250) 1495 2421 HSSTROL3_T10 (SEQ ID NO:251) 1215 2141

Segment cluster HSSTROL3_node.sub.--29 (SEQ ID NO:264) according to the present invention is supported by 109 libraries. The number of libraries was determined as previously described. This segment can be found in the following transcript(s): HSSTROL3_T5 (SEQ ID NO:248), HSSTROL3_T8 (SEQ ID NO:249), HSSTROL3_T9 (SEQ ID NO:250), HSSTROL3_T11 (SEQ ID NO:251), HSSTROL3_T11 (SEQ ID NO:252) and HSSTROL3_T12 (SEQ ID NO:253). Table 27 below describes the starting and ending position of this segment on each transcript. TABLE-US-00514 TABLE 27 Segment location on transcripts Segment Segment Transcript name starting position ending position HSSTROL3_T5 (SEQ ID NO:248) 2284 3194 HSSTROL3_T8 (SEQ ID NO:249) 1795 2705 HSSTROL3_T9 (SEQ ID NO:250) 2422 3332 HSSTROL3_T10 (SEQ ID NO:251) 2142 3052 HSSTROL3_T11 (SEQ ID NO:252) 1449 2359 HSSTROL3_T12 (SEQ ID NO:253) 1167 2077

According to an optional embodiment of the present invention, short segments related to the above cluster are also provided. These segments are up to about 120 bp in length, and so are included in a separate description.

Segment cluster HSSTROL3_node.sub.--11 (SEQ ID NO:265) according to the present invention is supported by 25 libraries. The number of libraries was determined as previously described. This segment can be found in the following transcript(s): HSSTROL3_T5 (SEQ ID NO:248), HSSTROL3_T8 (SEQ ID NO:249), HSSTROL3_T9 (SEQ ID NO:250), HSSTROL3_T10 (SEQ ID NO:251) and HSSTROL3_T11 (SEQ ID NO:252). Table 28 below describes the starting and ending position of this segment on each transcript. TABLE-US-00515 TABLE 28 Segment location on transcripts Segment Segment Transcript name starting position ending position HSSTROL3_T5 (SEQ ID NO:248) 314 361 HSSTROL3_T8 (SEQ ID NO:249) 314 361 HSSTROL3_T9 (SEQ ID NO:250) 314 361 HSSTROL3_T10 (SEQ ID NO:251) 314 361 HSSTROL3_T11 (SEQ ID NO:252) 314 361

Segment cluster HSSTROL3_node.sub.--17 (SEQ ID NO:266) according to the present invention is supported by 45 libraries. The number of libraries was determined as previously described. This segment can be found in the following transcript(s): HSSTROL3_T5 (SEQ ID NO:248), HSSTROL3_T8 (SEQ ID NO:249), HSSTROL3_T9 (SEQ ID NO:250), HSSTROL3_T10 (SEQ ID NO:251), HSSTROL3_T11 (SEQ ID NO:252) and HSSTROL3_T12 (SEQ ID NO:253). Table 29 below describes the starting and ending position of this segment on each transcript. TABLE-US-00516 TABLE 29 Segment location on transcripts Segment Segment Transcript name starting position ending position HSSTROL3_T5 (SEQ ID NO:248) 640 680 HSSTROL3_T8 (SEQ ID NO:249) 640 680 HSSTROL3_T9 (SEQ ID NO:250) 640 680 HSSTROL3_T10 (SEQ ID NO:251) 640 680 HSSTROL3_T11 (SEQ ID NO:252) 640 680 HSSTROL3_T12 (SEQ ID NO:253) 592 632

Segment cluster HSSTROL3_node.sub.--18 (SEQ ID NO:267) according to the present invention can be found in the following transcript(s): HSSTROL3_T5 (SEQ ID NO:248), HSSTROL3_T8 (SEQ ID NO:249), HSSTROL3_T9 (SEQ ID NO:250), HSSTROL3_T10 (SEQ ID NO:251), HSSTROL3_T11 (SEQ ID NO:252) and HSSTROL3_T12 (SEQ ID NO:253). Table 30 below describes the starting and ending position of this segment on each transcript. TABLE-US-00517 TABLE 30 Segment location on transcripts Segment Segment Transcript name starting position ending position HSSTROL3_T5 (SEQ ID NO:248) 681 698 HSSTROL3_T8 (SEQ ID NO:249) 681 698 HSSTROL3_T9 (SEQ ID NO:250) 681 698 HSSTROL3_T10 (SEQ ID NO:251) 681 698 HSSTROL3_T11 (SEQ ID NO:252) 681 698 HSSTROL3_T12 (SEQ ID NO:253) 633 650

Segment cluster HSSTROL3_node.sub.--20 (SEQ ID NO:268) according to the present invention is supported by 1 libraries. The number of libraries was determined as previously described. This segment can be found in the following transcript(s): HSSTROL3_T11 (SEQ ID NO:252). Table 31 below describes the starting and ending position of this segment on each transcript. TABLE-US-00518 TABLE 31 Segment location on transcripts Segment Segment Transcript name starting position ending position HSSTROL3_T11 (SEQ ID NO:252) 882 973

Segment cluster HSSTROL3_node.sub.--27 (SEQ ID NO:269) according to the present invention is supported by 50 libraries. The number of libraries was determined as previously described. This segment can be found in the following transcript(s): HSSTROL3_T5 (SEQ ID NO:248), HSSTROL3_T8 (SEQ ID NO:249), HSSTROL3_T9 (SEQ ID NO:250), HSSTROL3_T10 (SEQ ID NO:251), HSSTROL3_T11 (SEQ ID NO:252) and HSSTROL3_T12 (SEQ ID NO:253). Table 32 below describes the starting and ending position of this segment on each transcript. TABLE-US-00519 TABLE 32 Segment location on transcripts Segment Segment Transcript name starting position ending position HSSTROL3_T5 (SEQ ID NO:248) 1241 1356
HSSTROL3_T8 (SEQ ID NO:249) 1679 1794
HSSTROL3_T9 (SEQ ID NO:250) 1379 1494
HSSTROL3_T10 (SEQ ID NO:251) 1099 1214
HSSTROL3_T11 (SEQ ID NO:252) 1333 1448
HSSTROL3_T12 (SEQ ID NO:253) 1051 1166

Variant protein alignment to the previously known protein:
Sequence name: MM11_HUMAN (SEQ ID NO:270)
Sequence documentation:
Alignment of: HSSTROL3_P4 (SEQ ID NO:271).times. MM11_HUMAN (SEQ ID NO:270).

Alignment segment 1/1: TABLE-US-00520 Quality: 4444.00 Escore: 0 Matching length: 445 Total length: 445 Matching Percent 99.78 Matching Percent Identity: 99.78 Similarity: Total Percent Similarity: 99.78 Total Percent Identity: 99.78 Gaps: 0

Sequence name: MM11_HUMAN (SEQ ID NO:270)

Sequence documentation:

Alignment of: HSSTROL3_P5 (SEQ ID NO:272).times. MM11_HUMAN (SEQ ID NO:270).

Alignment segment 1/1: TABLE-US-00522 Quality: 3566.00 Escore: 0 Matching length: 358 Total length: 358 Matching Percent 99.72 Matching Percent Identity: 99.72 Similarity: Total Percent Similarity: 99.72 Total Percent Identity: 99.72 Gaps: 0

```
Alignment: TABLE-US-00521 . . . 1
MAPAAWLRSAAARALLPPMLLLLLQPPPLLARALPPDVHHLHAERRGPQP    50
||||||||||||||||||||||||||||||||||||||||||||||||||     1
MAPAAWLRSAAARALLPPMLLLLLQPPPLLARALPPDVHHLHAERRGPQP    50 . . . 51

WHAALPSSPAPAPATQEAPRPASSLRPPRCGVPDPSDGLSARNRQKRFVL   100
||||||||||||||||||||||||||||||||||||||||||||||||||    51
WHAALPSSPAPAPATQEAPRPASSLRPPRCGVPDPSDGLSARNRQKRFVL   100 . . . 101

SGGRWEKTDLTYRILRFPWQLVQEQVRQTMAEALKVWSDVTPLTFTEVHE   150
||||||||||||||||||||||||||||||||||||||||||||||||||   101
SGGRWEKTDLTYRILRFPWQLVQEQVRQTMAEALKVWSDVTPLTFTEVHE   150 . . . 151

GRADIMIDFARYWHGDDLPFDGPGGILAHAFFPKTHREGDVHFDYDETWT   200
|||||||||||||| |||||||||||||||||||||||||||||||||||   151
GRADIMIDFARYWDGDDLPFDGPGGILAHAFFPKTHREGDVHFDYDETWT   200 . . . 201

IGDDQGTDLLQVAAHEFGHVLGLQHTTAAKALMSAFYTFRYPLSLSPDDC   250
||||||||||||||||||||||||||||||||||||||||||||||||||   201
IGDDQGTDLLQVAAHEFGHVLGLQHTTAAKALMSAFYTFRYPLSLSPDDC   250 . . . 251

RGVQHLYGQPWPTVTSRTPALGPQAGIDTNEIAPLEPDAPPDACEASFDA   300
||||||||||||||||||||||||||||||||||||||||||||||||||   251
RGVQHLYGQPWPTVTSRTPALGPQAGIDTNEIAPLEPDAPPDACEASFDA   300 . . . 301

VSTIRGELFFFKAGFVWRLRGGQLQPGYPALASRHWQGLPSPVDAAFEDA   350
||||||||||||||||||||||||||||||||||||||||||||||||||   301
VSTIRGELFFFKAGFVWRLRGGQLQPGYPALASRHWQGLPSPVDAAFEDA   350 . . . 351

QGHIWFFQGAQYWVYDGEKPVLGPAPLTELGLVRFPVHAALVWGPEKNKI   400
||||||||||||||||||||||||||||||||||||||||||||||||||   351
QGHIWFFQGAQYWVYDGEKPVLGPAPLTELGLVRFPVHAALVWGPEKNKI   400 . . . 401

YFFRGRDYWRFHPSTRRVDSPVPRRATDWRGVPSEIDAAFQDADG        445
||||||||||||||||||||||||||||||||||||||||||||        401
YFFRGRDYWRFHPSTRRVDSPVPRRATDWRGVPSEIDAAFQDADG        445
```

```
Alignment: TABLE-US-00523 . . . 1
MAPAAWLRSAAARALLPPMLLLLLQPPPLLARALPPDVHHLHAERRGPQP    50
||||||||||||||||||||||||||||||||||||||||||||||||||     1
MAPAAWLRSAAARALLPPMLLLLLQPPPLLARALPPDVHHLHAERRGPQP    50 . . . 51

WHAALPSSPAPAPATQEAPRPASSLRPPRCGVPDPSDGLSARNRQKRFVL   100
||||||||||||||||||||||||||||||||||||||||||||||||||    51
WHAALPSSPAPAPATQEAPRPASSLRPPRCGVPDPSDGLSARNRQKRFVL   100 . . . 101

SGGRWEKTDLTYRILRFPWQLVQEQVRQTMAEALKVWSDVTPLTFTEVHE   150
||||||||||||||||||||||||||||||||||||||||||||||||||   101
SGGRWEKTDLTYRILRFPWQLVQEQVRQTMAEALKVWSDVTPLTFTEVHE   150 . . . 151

GRADIMIDFARYWDGDDLPFDGPGGILAHAFFPKTHREGDVHFDYDETWT   200
||||||||||||||||||||||||||||||||||||||||||||||||||   151
GRADIMIDFARYWDGDDLPFDGPGGILAHAFFPKTHREGDVHFDYDETWT   200 . . . 201
```

```
                              -continued
IGDDQGTDLLQVAAHEFGHVLGLQHTTAAKALMSAFYTFRYPLSLSPDDC   250
|||||||||||||||||||||||||||||||||||||||||||||||||   201
IGDDQGTDLLQVAAHEFGHVLGLQHTTAAKALMSAFYTFRYPLSLSPDDC   250 . . . 251

RGVQHLYGQPWPTVTSRTPALGPQAGIDTNEIAPLEPDAPPDACEASFDA   300
|||||||||||||||||||||||||||||||||||||||||||||||||   251
RGVQHLYGQPWPTVTSRTPALGPQAGIDTNEIAPLEPDAPPDACEASFDA   300 . . . 301

VSTIRGELFFFKAGFVWRLRGGQLQPGYPALASRHWQGLPSPVDAAFEDA   350
|||||||||||||||||||||||||||||||||||||||||||||||||   301
VSTIRGELFFFKAGFVWRLRGGQLQPGYPALASRHWQGLPSPVDAAFEDA   350 . . . 351

QGHIWFFQ                                            358
||||||||                                            351
QGHIWFFQ                                            358
```

Sequence name: MM11_HUMAN (SEQ ID NO:270)
Sequence documentation:
Alignment of: HSSTROL3_P7 (SEQ ID NO:273).times. MM11_HUMAN (SEQ ID NO:270).
Alignment segment 1/1: TABLE-US-00524 Quality: 3575.00 Escore: 0 Matching length: 359 Total length: 359 Matching Percent 99.72 Matching Percent Identity: 99.72 Similarity: Total Percent Similarity: 99.72 Total Percent Identity: 99.72 Gaps: 0

Sequence name: MM11_HUMAN (SEQ ID NO:270)
Sequence documentation:
Alignment of: HSSTROL3_P8 (SEQ ID NO:274).times. MM11_HUMAN (SEQ ID NO:270).
Alignment segment 1/1: TABLE-US-00526 Quality: 2838.00 Escore: 0 Matching length: 286 Total length: 286 Matching Percent 99.65 Matching Percent Identity: 99.65 Similarity: Total Percent Similarity: 99.65 Total Percent Identity: 99.65 Gaps: 0

```
Alignment: TABLE-US-00525 . . . 1
MAPAAWLRSAAARALLPPMLLLLLQPPPLLARALPPDVHHLHAERRGPQP   50
|||||||||||||||||||||||||||||||||||||||||||||||||   1
MAPAAWLRSAAARALLPPMLLLLLQPPPLLARALPPDVHHLHAERRGPQP   50 . . . 51

WHAALPSSPAPAPATQEAPRPASSLRPPRCGVPDPSDGLSARNRQKRFVL   100
|||||||||||||||||||||||||||||||||||||||||||||||||   51
WHAALPSSPAPAPATQEAPRPASSLRPPRCGVPDPSDGLSARNRQKRFVL   100 . . . 101

SGGRWEKTDLTYRILRFPWQLVQEQVRQTMAEALKVWSDVTPLTFTEVHE   150
|||||||||||||||||||||||||||||||||||||||||||||||||   101
SGGRWEKTDLTYRILRFPWQLVQEQVRQTMAEALKVWSDVTPLTFTEVHE   150 . . . 151

GRADIMIDFARYWHGDDLPFDGPGGILAHAFFPKTHREGDVHFDYDETWT   200
||||||||||||||| |||||||||||||||||||||||||||||||||   151
GRADIMIDFARYWDGDDLPFDGPGGILAHAFFPKTHREGDVHFDYDETWT   200 . . . 201

IGDDQGTDLLQVAAHEFGHVLGLQHTTAAKALMSAFYTFRYPLSLSPDDC   250
|||||||||||||||||||||||||||||||||||||||||||||||||   201
IGDDQGTDLLQVAAHEFGHVLGLQHTTAAKALMSAFYTFRYPLSLSPDDC   250 . . . 251

RGVQHLYGQPWPTVTSRTPALGPQAGIDTNEIAPLEPDAPPDACEASFDA   300
|||||||||||||||||||||||||||||||||||||||||||||||||   251
RGVQHLYGQPWPTVTSRTPALGPQAGIDTNEIAPLEPDAPPDACEASFDA   300 . . . 301

VSTIRGELFFFKAGFVWRLRGGQLQPGYPALASRHWQGLPSPVDAAFEDA   350
|||||||||||||||||||||||||||||||||||||||||||||||||   301
VSTIRGELFFFKAGFVWRLRGGQLQPGYPALASRHWQGLPSPVDAAFEDA   350 . . . 351

QGHIWFFQG                                           359
|||||||||                                           351
QGHIWFFQG                                           359

Alignment: TABLE-US-00527 . . . 1
MAPAAWLRSAAARALLPPMLLLLLQPPPLLARALPPDVHHLHAERRGPQP   50
|||||||||||||||||||||||||||||||||||||||||||||||||   1
MAPAAWLRSAAARALLPPMLLLLLQPPPLLARALPPDVHHLHAERRGPQP   50 . . . 51

WHAALPSSPAPAPATQEAPRPASSLRPPRCGVPDPSDGLSARNRQKRFVL   100
|||||||||||||||||||||||||||||||||||||||||||||||||   51
WHAALPSSPAPAPATQEAPRPASSLRPPRCGVPDPSDGLSARNRQKRFVL   100 . . . 101

SGGRWEKTDLTYRILRFPWQLVQEQVRQTMAEALKVWSDVTPLTFTEVHE   150
```

```
                                                          -continued
|||||||||||||||||||||||||||||||||||||||||       101
SGGRWEKTDLTYRILRFPWQLVQEQVRQTMAEALKVWSDVTPLTFTEVHE         150 . . . 151

GRADIMIDFARYWHGDDLPFDGPGGILAHAFFPKTHREGDVHFDYDETWT         200
|||||||||||||||||| |||||||||||||||||||||||||||||||        151
GRADIMIDFARYWDGDDLPFDGPGGILAHAFFPKTHREGDVHFDYDETWT         200 . . . 201

IGDDQGTDLLQVAAHEFGHVLGLQHTTAAKALMSAFYTFRYPLSLSPDDC         250
||||||||||||||||||||||||||||||||||||||||||||||||||        201
IGDDQGTDLLQVAAHEFGHVLGLQHTTAAKALMSAFYTFRYPLSLSPDDC         250 . . . 251

RGVQHLYGQPWPTVTSRTPALGPQAGIDTNEIAPLE                      286
|||||||||||||||||||||||||||||||||||                       251
RGVQHLYGQPWPTVTSRTPALGPQAGIDTNEIAPLE                      286
```

Sequence name: MM11_HUMAN (SEQ ID NO:270)
Sequence documentation:
Alignment of: HSSTROL3_P9 (SEQ ID NO:275).times. MM11_HUMAN (SEQ ID NO:270).
Alignment segment 1/1: TABLE-US-00528 Quality: 3316.00 Escore: 0 Matching length: 343 Total length: 359 Matching Percent 99.71 Matching Percent Identity: 99.71 Similarity: Total Percent Similarity: 95.26 Total Percent Identity: 95.26 Gaps: 1

```
Alignment: TABLE-US-00529 . . . 1
MAPAAWLRSAAARALLPPMLLLLLQPPPLLARALPPDVHHLHAERRGPQP         50
|||||||||||||||||||||||||||||||||||||||||||||||||         1
MAPAAWLRSAAARALLPPMLLLLLQPPPLLARALPPDVHHLHAERRGPQP         50 . . . 51

WHAALPSSPAPAPATQEAPRPASSLRPPRCGVPDPSDGLSARNRQK....        96
|||||||||||||||||||||||||||||||||||||||||||||             51
WHAALPSSPAPAPATQEAPRPASSLRPPRCGVPDPSDGLSARNRQKRFVL        100 . . . 97

...........RILRFPWQLVQEQVRQTMAEALKVWSDVTPLTFTEVHE         134
            |||||||||||||||||||||||||||||||||||||        101
SGGRWEKTDLTYRILRFPWQLVQEQVRQTMAEALKVWSDVTPLTFTEVHE        150 . . . 135

GRADIMIDFARYWHGDDLPFDGPGGILAHAFFPKTHREGDVHFDYDETWT        184
|||||||||||||| |||||||||||||||||||||||||||||||||||       151
GRADIMIDFARYWDGDDLPFDGPGGILAHAFFPKTHREGDVHFDYDETWT        200 . . . 185

IGDDQGTDLLQVAAHEFGHVLGLQHTTAAKALMSAFYTFRYPLSLSPDDC        234
||||||||||||||||||||||||||||||||||||||||||||||||||       201
IGDDQGTDLLQVAAHEFGHVLGLQHTTAAKALMSAFYTFRYPLSLSPDDC        250 . . . 235

RGVQHLYGQPWPTVTSRTPALGPQAGIDTNEIAPLEPDAPPDACEASFDA        284
||||||||||||||||||||||||||||||||||||||||||||||||||       251
RGVQHLYGQPWPTVTSRTPALGPQAGIDTNEIAPLEPDAPPDACEASFDA        300 . . . 285

VSTIRGELFFFKAGFVWRLRGGQLQPGYPALASRHWQGLPSPVDAAFEDA        334
||||||||||||||||||||||||||||||||||||||||||||||||||       301
VSTIRGELFFFKAGFVWRLRGGQLQPGYPALASRHWQGLPSPVDAAFEDA        350 . . . 335

QGHIWFFQG                                                 343
|||||||||                                                 351
QGHIWFFQG                                                 359
```

Expression of Stromelysin-3 Precursor (EC 3.4.24.-) (Matrix Metalloproteinase-11) (MMP-11) (ST3) SL-3 HSSTROL3 Transcripts which Are Detectable by Amplicon as Depicted in Sequence Name HSSTROL3 seg24 (SEQ ID NO:869) in Normal and Cancerous Breast Tissues Expression of Stromelysin-3 precursor (EC 3.4.24.-) (Matrix metalloproteinase-11) (MMP-11) (ST3) (SL-3 transcripts detectable by or according to seg24 HSSTROL3 seg24 (SEQ ID NO:869) amplicon(s) and HSSTROL3 seg24F (SEQ ID NO:867) and HSSTROL3 seg24R (SEQ ID NO:868) primers was measured by real time PCR. In parallel the expression of four housekeeping genes PBGD (GenBank Accession No. BC01 9323 (SEQ ID NO:926); amplicon—PBGD-amplicon (SEQ ID NO:929)), HPRT1 (GenBank Accession No. NM.sub.--000194 (SEQ ID NO:930); amplicon—HPRT1-amplicon (SEQ ID NO:933)) SDHA(GenBank Accession No. NM.sub.--004168 (SEQ ID NO:922); amplicon—SDHA-amplicon (SEQ ID NO:925)) and G6PD (GenBank Accession No. NM.sub.--000402 (SEQ ID NO:918); G6PD-amplicon (SEQ ID NO:921)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 1, above, "Tissue samples in testing panel"), to obtain a value of fold up-regulation for each sample relative to median of the normal PM samples.

Figure 29A:
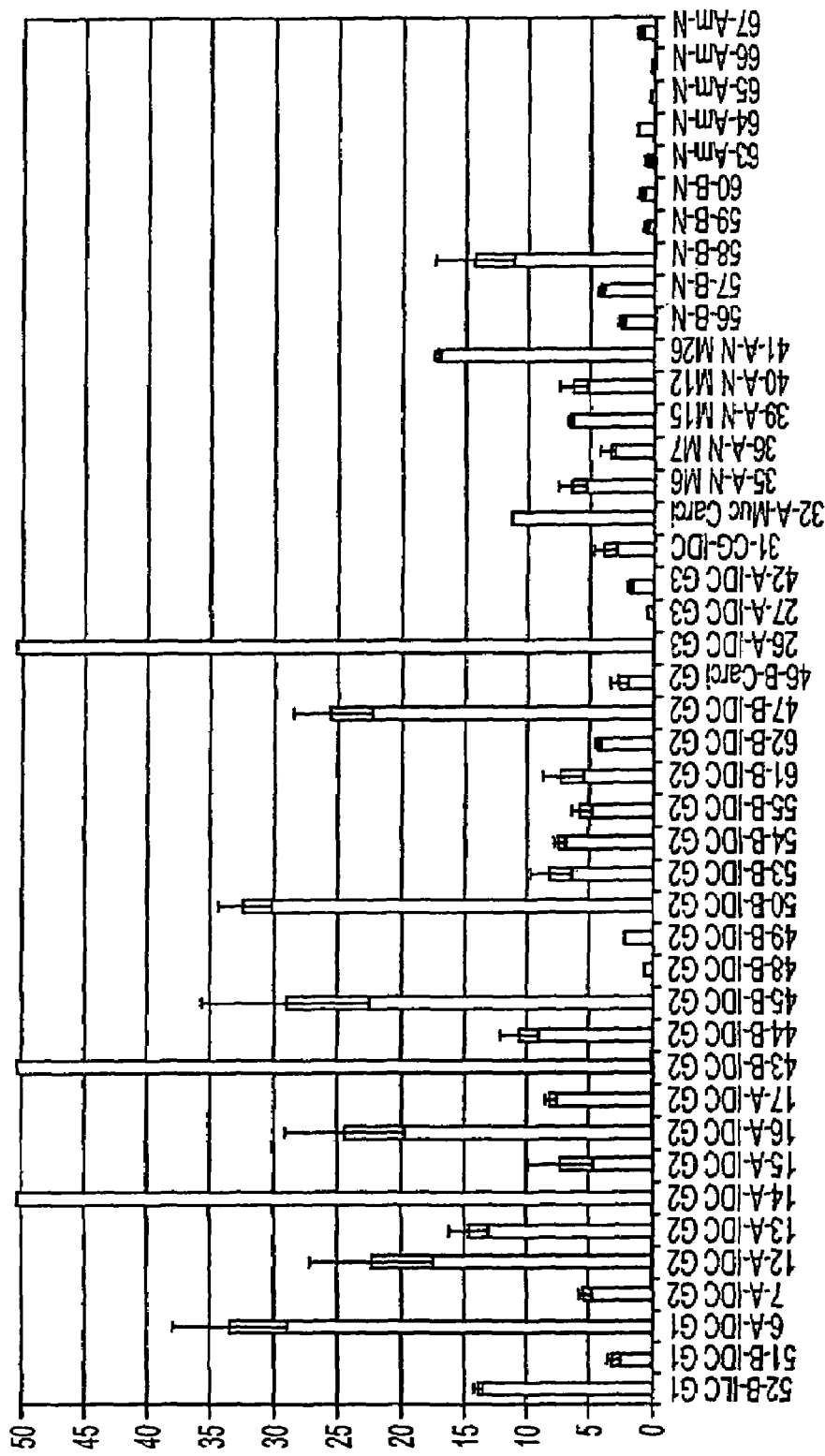
FIG. 29A is a histogram showing the expression of Expression of Stromelysin-3 precursor (SEQ ID NO:270) (EC 3.4.24.-) (Matrix metalloproteinase-11) (MMP-11) (ST3) SL-3 HSSTROL3 transcripts which are detectable by amplicon as depicted in sequence name HSSTROL3 seg24 (SEQ ID NO:869) in normal and cancerous breast tissues.

FIG. 29A is a histogram showing over expression of the above-indicated Stromelysin-3 precursor (EC 3.4.24.-) (Matrix metalloproteinase-11) (MMP-11) (ST3) (SL-3) transcripts in cancerous breast samples relative to the normal samples. Values represent the average of duplicate experiments. Error bars indicate the minimal and maximal values obtained.

As is evident from FIG. 29A, the expression of Stromelysin-3 precursor (EC 3.4.24.-) (Matrix metalloproteinase-11) (MMP-11) (ST3) (SL-3) transcripts detectable by the above amplicon(s) in cancer samples was significantly higher than in the non-cancerous samples (Sample Nos.56-60, 63-67 Table 1, "Tissue samples in testing panel"). Notably an overexpression of at least 5 fold was found in 20 out of 28 adenocarcinoma samples.

Statistical analysis was applied to verify the significance of these results, as described below.

The P value for the difference in the expression levels of Stromelysin-3 precursor(EC 3.4.24.-) (Matrix metalloproteinase-11) (MMP-11) (ST3) (SL-3) transcripts detectable by the above amplicon(s) in Breast cancer samples versus the normal tissue samples was determined by T test as 6.46E-03.

Threshold of 5 fold overexpression was found to differentiate between cancer and normal samples with P value of 1.12E-03 as checked by exact fisher test. The above values demonstrate statistical significance of the results. Primer pairs are also optionally and preferably encompassed within the present invention; for example, for the above experiment, the following primer pair was used as a non-limiting illustrative example only of a suitable primer pair: HSSTROL3 seg24F forward primer (SEQ ID NO:867); and HSSTROL3 seg24R reverse primer (SEQ ID NO:868).The present invention also preferably encompasses any amplicon obtained through the use of any suitable primer pair; for example, for the above experiment, the following amplicon was obtained as a non-limiting illustrative example only of a suitable amplicon: HSSTROL3 seg24 (SEQ ID NO:869). TABLE-US-00530 HSSTROL3 seg24 Forward Primer (SEQ ID NO:867): ATTTCCATCCTCAACTGGCAGA HSSTROL3 seg24 Reverse Primer (SEQ ID NO:868): TGCCCTGGAACCCACG HSSTROL3 seg24 Amplicon: (SEQ ID NO:869): ATTTCCATCCTCAACTGGCAGAGATGAGAGCCTGGAGCATTGCAGATGCC AGGGACTTCACAAATGAAGGCACAGCATGGGAAACCTGCGTGGGTTCCAG GGCA Expression of Stromelysin-3 Precursor (EC 3.4.24.-) (Matrix Metalloproteinase-11) (MMP-11) (ST3) (SL-3)HSSTROL3 Transcripts which are Detectable by Amplicon as Depicted in Sequence Name HSSTROL3 seg24 (SEQ ID NO:869) in Different Normal Tissues Expression of Stromelysin-3 precursor (EC 3.4.24.-) (Matrix metalloproteinase-11) (MMP-11) (ST3) (SL-3) transcripts detectable by or according to HSSTROL3 seg24 (SEQ ID NO:869) amplicon(s) and HSSTROL3 seg24F (SEQ ID NO:867) and HSSTROL3 seg24R (SEQ ID NO:868) was measured by real time PCR. In parallel the expression of four housekeeping genes UBC (GenBank Accession No. BC000449 (SEQ ID NO:942); amplicon—Ubiquitin-amplicon (SEQ ID NO:945)) and SDHA (GenBank Accession No. NM.sub.--004168 (SEQ ID NO:922); amplicon—SDHA-amplicon (SEQ ID NO:925)), RPL19 (GenBank Accession No. NM.sub.--000981 (SEQ ID NO:934); RPL19 amplicon (SEQ ID NO:937)), TATA box (GenBank Accession No. NM.sub.--003194 (SEQ ID NO:938; TATA amplicon (SEQ ID NO:941)) was measured similarly. For each RT sample, the expression of the above amplicon was normalized to the geometric mean of the quantities of the housekeeping genes. The normalized quantity of each RT sample was then divided by the median of the quantities of the lung samples (sample Nos. 15-17 Table 2, "Tissue samples on normal panel" above), to obtain a value of relative expression of each sample relative to median of the lung samples. Primers and amplicon are as above.

Figure 29B:
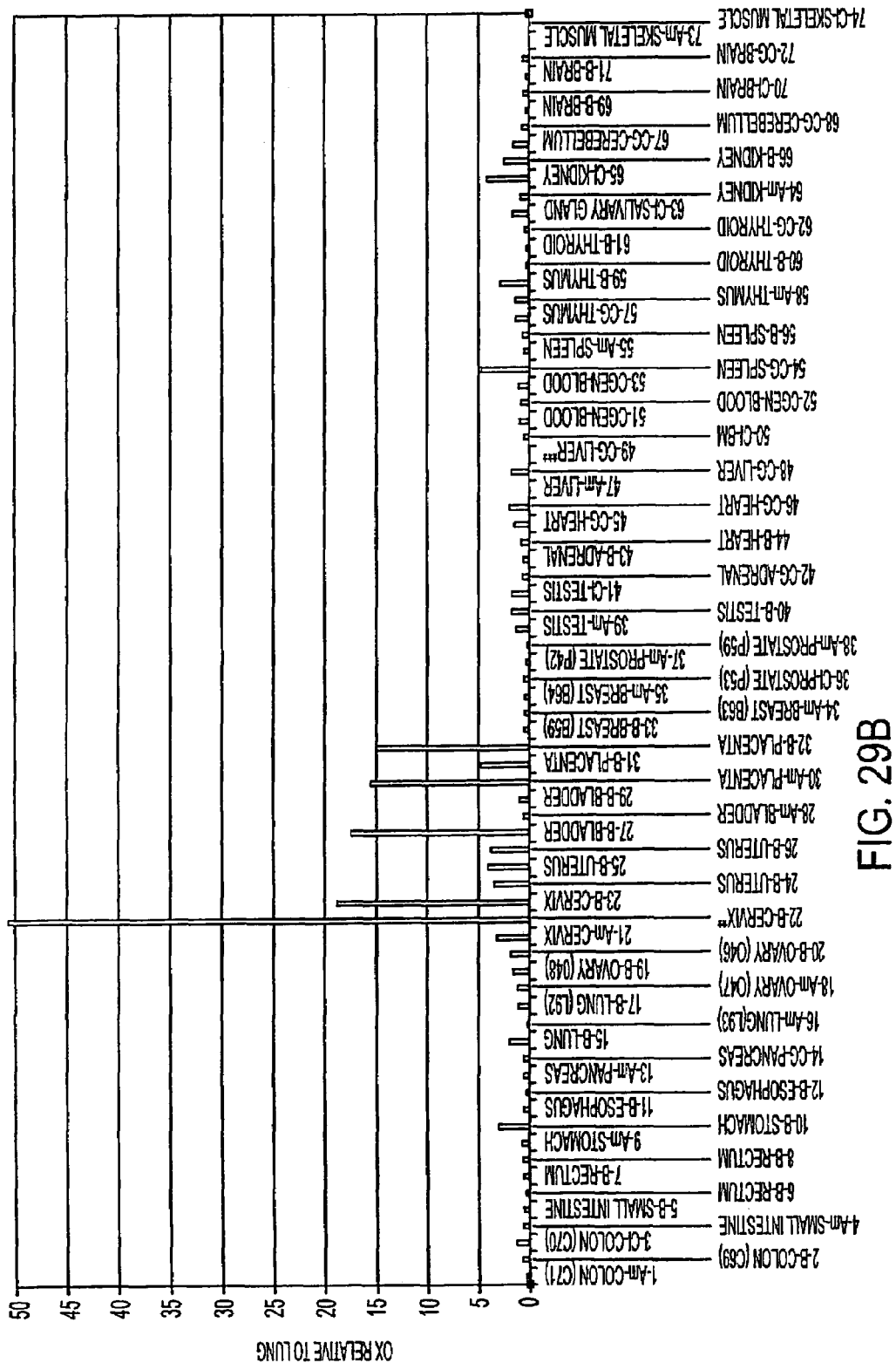
FIG. 29B is a histogram showing the expression of Stromelysin-3 precursor (SEQ ID NO:270) (EC 3.4.24.-) (Matrix metalloproteinase-11) (MMP-11) (ST3) (SL-3) HSSTROL3 transcripts, which are detectable by amplicon as depicted in sequence name HSSTROL3 seg24 (SEQ ID NO:869), in different normal tissues.

The results are presented in FIG. 29B, demonstrating the expression of Stromelysin-3 precursor (EC 3.4.24.-) (Matrix metalloproteinase-11) (MMP-11) (ST3) (SL-3) HSSTROL3 transcripts, which are detectable by amplicon as depicted in sequence name HSSTROL3 seg24 (SEQ ID NO:869), in different normal tissues.

Expression of Stromelysin-3 Precursor (EC 3.4.24.-) (Matrix Metalloproteinase-11) (MMP-11) (ST3) (SL-3) HSSTROL3 Transcripts which are Detectable by Amplicon as Depicted in Sequence Name HSSTROL3 junc20-21 (SEQ ID NO:872) in Normal and Cancerous Breast Tissues Expression of Stromelysin-3 precursor transcripts detectable by or according to junc20-21, HSSTROL3junc20-21 (SEQ ID NO:872) amplicon(s) and primers HSSTROL3junc20-21F (SEQ ID NO:870) and HSSTROL3junc20-21R (SEQ ID NO:871) was measured by real time PCR. It should be noted that for this experiment, RNA was obtained from Clontech (Franklin Lakes, N.J. USA 07417, clontech.com), BioChain Inst. Inc. (Hayward, Calif. 94545 USA biochain.com), ABS (Wilmington, Del. 19801, USA, absbioreagents.com), GOG for ovary samples—Pediatic Cooperative Human Tissue Network, Gynecologic Oncology Group Tissue Bank, Children Hospital of Columbus (Columbus Ohio 43205 USA) or Ambion (Austin, Tex. 78744 USA, ambion.com). Alternatively, RNA was generated from tissue samples using TRI-Reagent (Molecular Research Center), according to Manufacturer's instructions. Tissue and RNA samples were obtained from patients or from postmortem. Total RNA samples were treated with DNaseI (Ambion).

In parallel the expression of four housekeeping genes—PBGD (GenBank Accession No. BC019323 (SEQ ID NO:926); amplicon—PBGD-amplicon (SEQ ID NO:929)), HPRT1 (GenBank Accession No. NM.sub.--000194 (SEQ ID NO:930); amplicon—HPRT1-amplicon (SEQ ID NO:933)), SDHA (GenBank Accession No. NM.sub.--004168 (SEQ ID NO:922); amplicon—SDHA-amplicon (SEQ ID NO:925)), G6PD (GenBank Accession No. NM.sub.--000402 (SEQ ID NO:918); G6PD-amplicon (SEQ ID NO:921)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 1: Tissue samples in testing panel, above), to obtain a value of fold up-regulation for each sample relative to median of the normal PM samples.

Figure 30A:
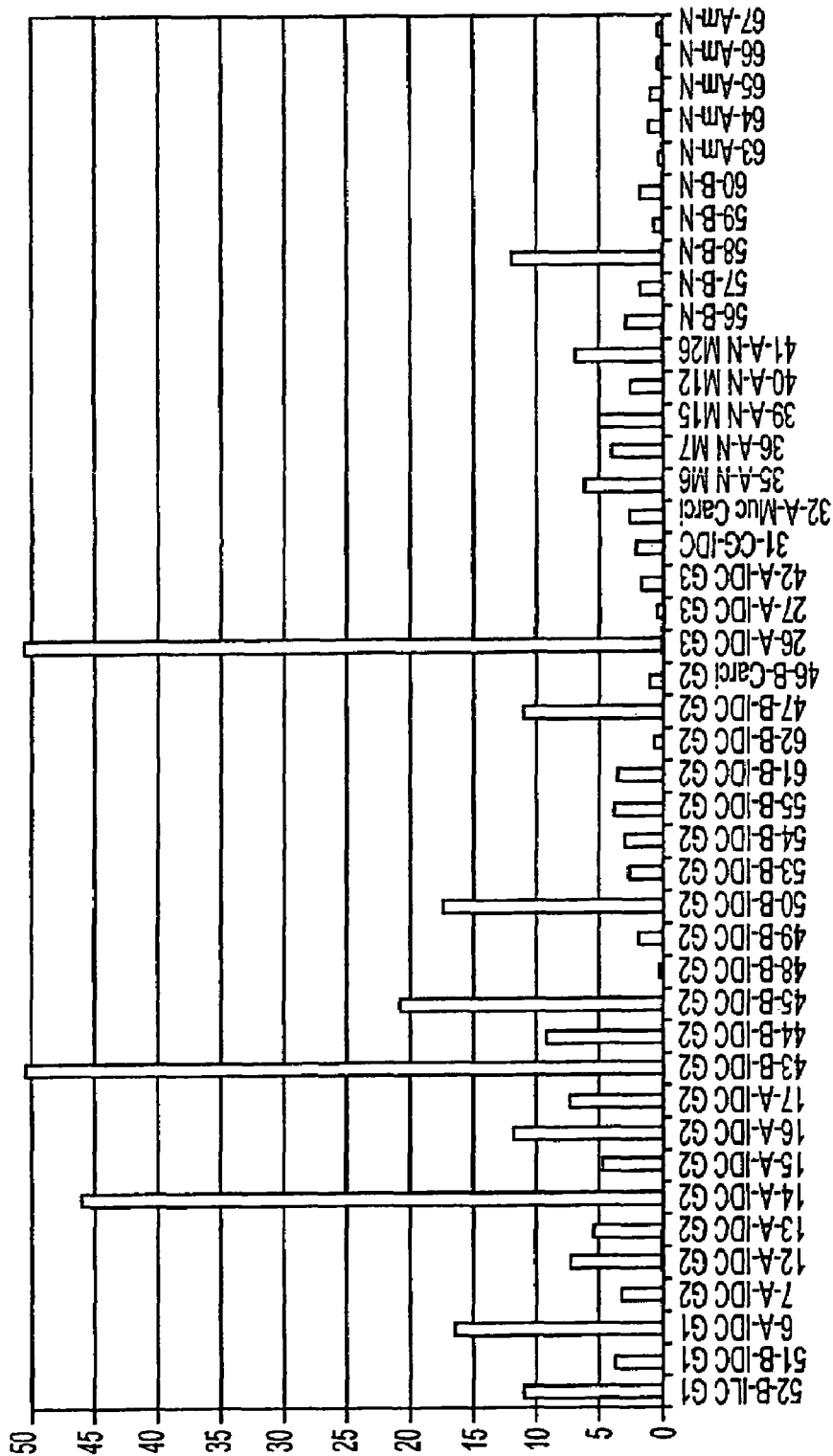
FIGS. 30A-30C shows histograms showing over expression of various Stromelysin-3 precursor (SEQ ID NO:270) transcripts in cancerous breast samples relative to the normal samples.

FIG. 30A is a histogram showing over expression of the above-indicated Stromelysin-3 precursor transcripts in cancerous breast samples relative to the normal samples.

As is evident from FIG. 30A, the expression of Stromelysin-3 precursor transcripts detectable by the above amplicon(s) in cancer samples was significantly higher than in the non-cancerous samples (Sample Nos. 56-60, 63-67, Table 1: Tissue samples in testing panel, above). Notably an over-expression of at least 5 fold was found in 13 out of 28 adenocarcinoma samples.

Statistical analysis was applied to verify the significance of these results, as described below.

The P value for the difference in the expression levels of Stromelysin-3 precursor transcripts detectable by the above amplicon(s) in breast cancer samples versus the normal tissue samples was determined by T test as 1.28E-02.

Threshold of 5 fold overexpression was found to differentiate between cancer and normal samples with P value of 4.26E-02 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: HSSTROL junc20-21F (SEQ ID NO:870) forward primer; and HSSTROL junc20-21R (SEQ ID NO:871) reverse primer.

The present invention also preferably encompasses any amplicon obtained through the use of any suitable primer pair; for example, for the above experiment, the following amplicon was obtained as a non-limiting illustrative example only of a suitable amplicon: HSSTROL junc20-21 (SEQ ID NO:872). TABLE-US-00531 Forward primer HSSTROL junc20-21F (SEQ ID NO:870): TCTGCTGGCCACTGT-GACTG Reverse primer HSSTROL junc20-21R (SEQ ID NO:871): GAAGAAAAAGAGCTCGCCTCG Amplicon HSSTROL junc20-21 (SEQ ID NO:872): TCTGCTGGC-CACTGTGACTGCAGCATATGCCCTCAG-CATGTGTCCCTCTC TCCCACCCCAGCCAGACGC-CCCGCCAGATGCCTGTGAGGCCTCCTTTGAC GCGGTCTCCACCATCCGAGGCGAGCTCTTTTCTTC Expression of Stromelysin-3 Precursor (EC 3.4.24.-) (Matrix Metalloproteinase-11) (MMP-11) (ST3) (SL-3) HSSTROL3 Transcripts which are Detectable by Amplicon as Depicted in Sequence Name HSSTROL3 junc21-27 (SEQ ID NO:875) in Normal and Cancerous Breast Tissues Expression of Stromelysin-3 precursor transcripts detectable by or according to junc21-27, HSSTROL3 junc21-27 (SEQ ID NO:875) amplicon(s) and primers HSSTROL3junc21-27F (SEQ ID NO:873) and HSSTROL3junc21-27R (SEQ ID NO:874) was measured by real time PCR (RNA was as for the experiment above). In parallel the expression of four housekeeping genes—PBGD (GenBank Accession No. BC019323 (SEQ ID NO:926); amplicon—PBGD-amplicon (SEQ ID NO:929)), HPRT1 (GenBank Accession No. NM.sub.--000194 (SEQ ID NO:930); amplicon—HPRT1-amplicon (SEQ ID NO:933)), SDHA (GenBank Accession No. NM.sub.--004168 (SEQ ID NO:922); amplicon—SDHA-amplicon (SEQ ID NO:925)), G6PD (GenBank Accession No. NM.sub.--000402 (SEQ ID NO:918); G6PD-amplicon (SEQ ID NO:921)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 1: Tissue samples in testing panel, above), to obtain a value of fold up-regulation for each sample relative to median of the normal PM samples.

Figure 30B:
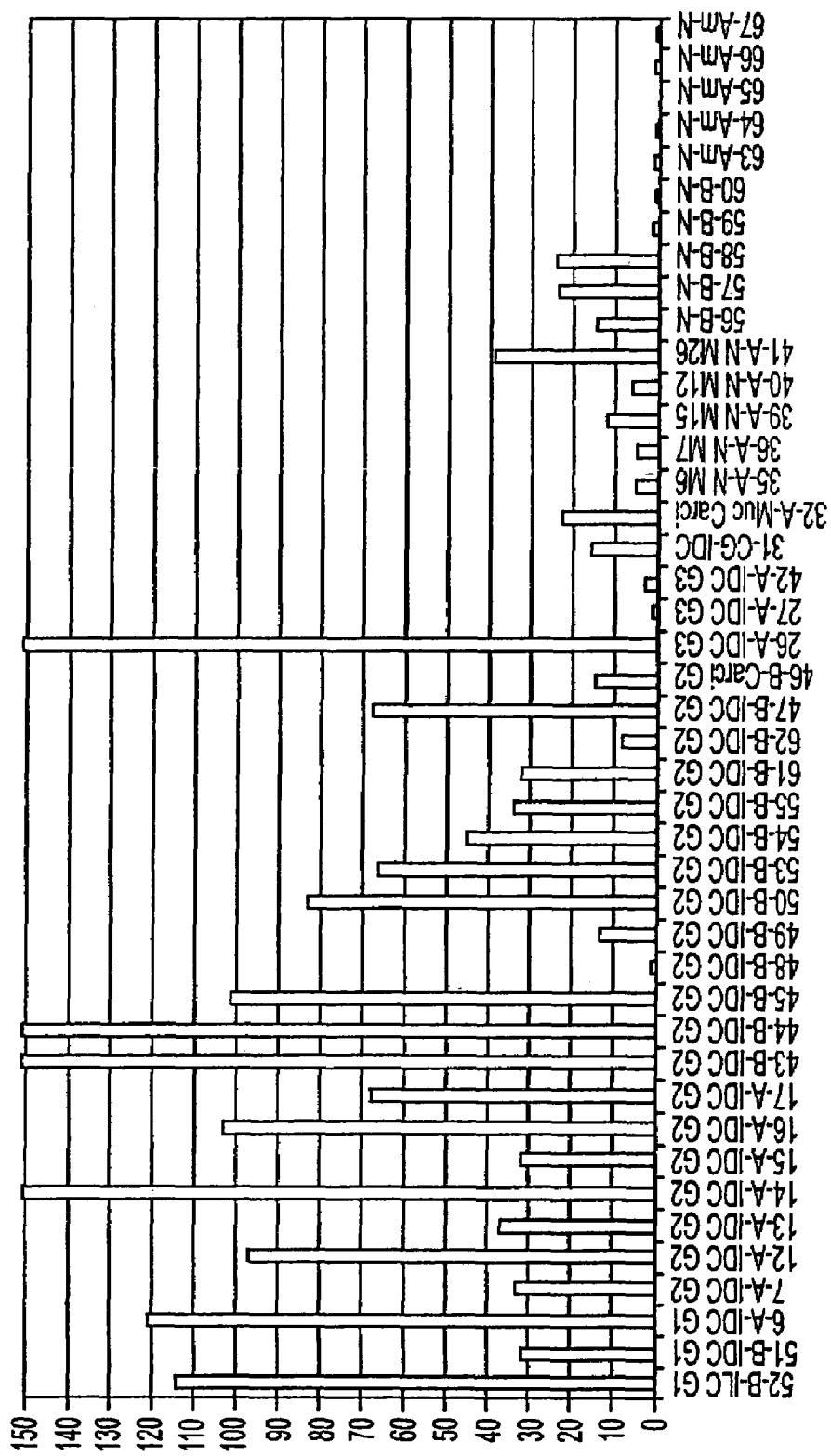

FIG. 30B is a histogram showing over expression of the above-indicated Stromelysin-3 precursor transcripts in cancerous breast samples relative to the normal samples.

As is evident from FIG. 30B, the expression of Stromelysin-3 precursor transcripts detectable by the above amplicon(s) in cancer samples was significantly higher than in the non-cancerous samples (Sample Nos. 56-60, 63-67 Table 1: Tissue samples in testing panel, above). Notably an over-expression of at least 20 fold was found in 20 out of 28 adenocarcinoma samples.

Statistical analysis was applied to verify the significance of these results, as described below.

The P value for the difference in the expression levels of Stromelysin-3 precursor transcripts detectable by the above amplicon(s) in breast cancer samples versus the normal tissue samples was determined by T test as 5.98E-03.

Threshold of 20 fold overexpression was found to differentiate between cancer and normal samples with P value of 3.66E-03 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: HSSTROL junc2l-27F forward primer (SEQ ID NO:873); and HSSTROL junc21-27R reverse primer (SEQ ID NO:874).

The present invention also preferably encompasses any amplicon obtained through the use of any suitable primer pair; for example, for the above experiment, the following amplicon was obtained as a non-limiting illustrative example only of a suitable amplicon: HSSTROL junc21-27 (SEQ ID NO:875). TABLE-US-00532 Forward primer HSSTROL junc21-27F (SEQ ID NO:873): ACATTTGGTTCTTC-CAAGGGACTAC Reverse primer HSSTROL junc21-27R (SEQ ID NO:874): TCGATCTCAGAGGGCACCC Amplicon HSSTROL junc21-27 (SEQ ID NO:875): ACATTTGGT-TCTTCCAAGGGACTACTGGCGTTTCCAC-CCCAGCACCCGGC GTGTAGACAGTCCCGTGCCCCGCAGGGC-CACTGACTGGAGAGGGGTGCCC TCTGAGATCGA Expression of Stromelysin-3 Precursor (EC 3.4.24.-) (Matrix Metalloproteinase-11) (MMP-11) (ST3) (SL-3) HSSTROL3 Transcripts which are Detectable by Amplicon as Depicted in Sequence Name HSSTROL3 seg25 (SEQ ID NO:878) in Normal and Cancerous Breast Tissues Expression of Stromelysin-3 precursor transcripts detectable by or according to seg25, HSSTROL3 junc21-27 (SEQ ID NO:878) amplicon(s) and primers HSSTROL3junc21-27F (SEQ ID NO:876) and HSSTROL3junc21-27R (SEQ ID NO:877) was measured by real time PCR (RNA was as for the experiment above). In parallel the expression of four housekeeping genes—PBGD (GenBank Accession No. BC019323 (SEQ ID NO:926); amplicon—PBGD-amplicon (SEQ ID NO:929)), HPRT1 (GenBank Accession No. NM.sub.--000194 (SEQ ID NO:930); amplicon—HPRT1-amplicon (SEQ ID NO:933)), SDHA (GenBank Accession No. NM.sub.--004168 (SEQ ID NO:922); amplicon—SDHA-amplicon (SEQ ID NO:925)), G6PD (GenBank Accession No. NM.sub.--000402 (SEQ ID NO:918); G6PD-amplicon (SEQ ID NO:921)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 1: Tissue samples in testing panel, above), to obtain a value of fold up-regulation for each sample relative to median of the normal PM samples.

Figure 30C:
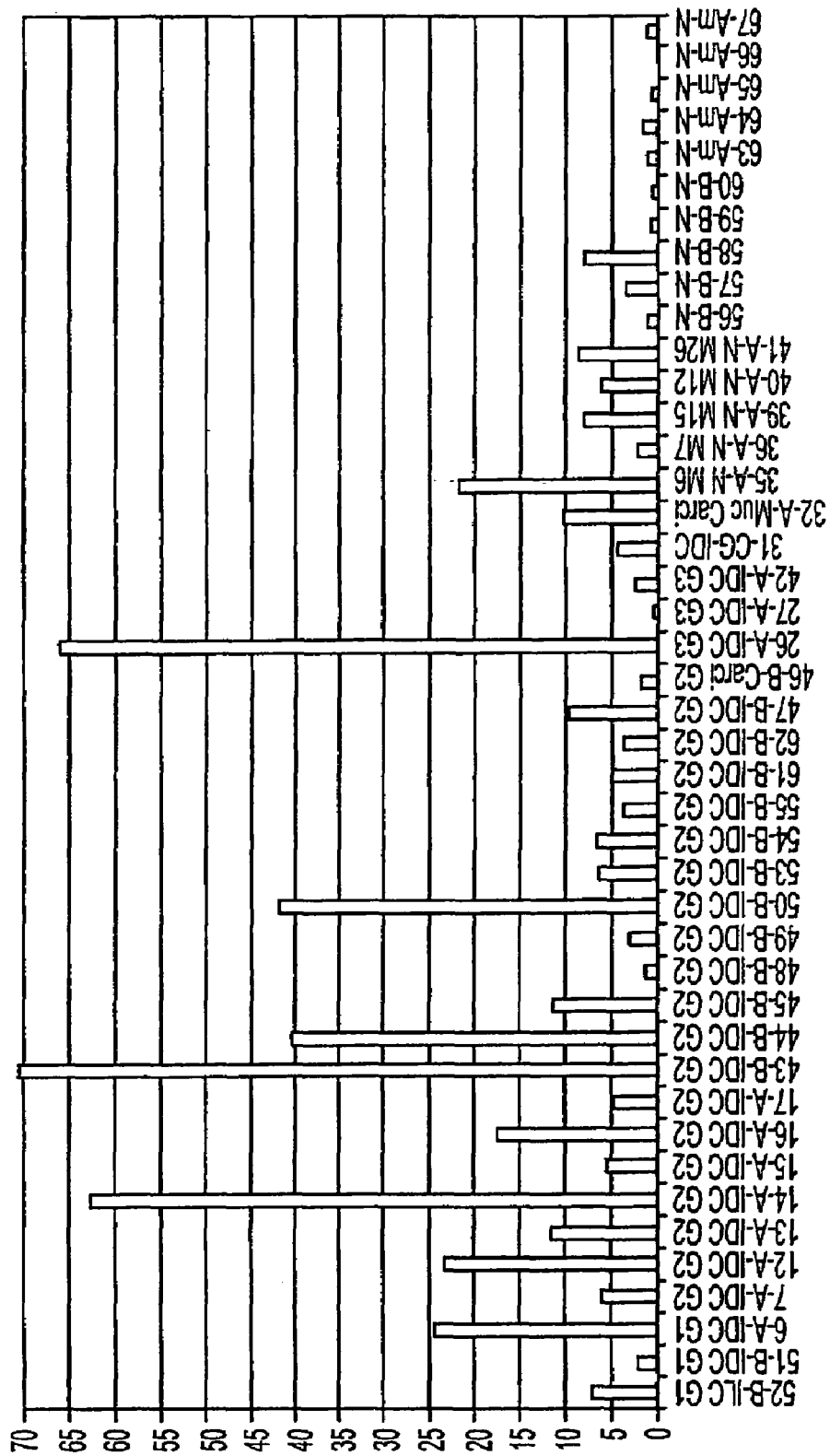

FIG. 30C is a histogram showing over expression of the above-indicated Stromelysin-3 precursor transcripts in cancerous breast samples relative to the normal samples.

As is evident from FIG. 30C, the expression of Stromelysin-3 precursor transcripts detectable by the above amplicon(s) in cancer samples was significantly higher than in the non-cancerous samples (Sample Nos. 56-60, 63-67 Table 1: Tissue samples in testing panel, above). Notably an over-expression of at least 5 fold was found in 20 out of 28 adenocarcinoma samples.

Statistical analysis was applied to verify the significance of these results, as described below.

The P value for the difference in the expression levels of Stromelysin-3 precursor transcripts detectable by the above amplicon(s) in breast cancer samples versus the normal tissue samples was determined by T test as 5.79E-02.

Threshold of 5 fold overexpression was found to differentiate between cancer and normal samples with P value of 6.75E-03 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: HSSTROL seg25F forward primer (SEQ ID NO:876); and HSSTROL seg25R reverse primer (SEQ ID NO:877).

The present invention also preferably encompasses any amplicon obtained through the use of any suitable primer pair; for example, for the above experiment, the following amplicon was obtained as a non-limiting illustrative example only of a suitable amplicon: HSSTROL seg25 (SEQ ID NO:878). TABLE-US-00533 Forward primer HSSTROL seg25F (SEQ ID NO:876): CACTGCCCCAGCTTATCCC Reverse primer HSSTROL seg25R (SEQ ID NO:877): CTCTCCCAGCCTCAGTTTCCT Amplicon HSSTROL seg25 (SEQ ID NO:878): CACTGCCCCAGCTTATC-CCAGGCCTCCCGCTTCCCTCTGCGGGTGGGGTG CTGAGCAGGCATTATTGGCCTGCAT-GTTTTACTGATGAGGAAACTGAGGC TGGGAGAG Description for Cluster AY1 80924

Cluster AY180924 features 1 transcript(s) and 3 segment(s) of interest, the names for which are given in Tables 1 and 2, respectively, the sequences themselves are given at the end of the application. The selected protein variants are given in table 3. TABLE-US-00534 TABLE 1 Transcripts of interest Transcript Name Sequence ID No. AY180924_PEA__1_T1276

TABLE-US-00535 TABLE 2 Segments of interest Segment Name Sequence ID No. AY180924_PEA__1_node__3 277 AY180924_PEA__1_node__0 278 AY180924_PEA__1_node__2 279

TABLE-US-00536 TABLE 3 Proteins of interest Protein Name Sequence ID No. AY180924_PEA__1_P3 281

These sequences are variants of the known protein Latherin precursor (SEQ ID NO:280) (SwissProt accession identifier LATH_HUMAN; known also according to the synonyms Breast cancer and salivary gland expressed protein), SEQ ID NO: 280, referred to herein as the previously known protein.

Protein Latherin precursor (SEQ ID NO:280) is known or believed to have the following function(s): surfactant properties. The sequence for protein Latherin precursor (SEQ ID NO:280) is given at the end of the application, as "Latherin precursor (SEQ ID NO:280) amino acid sequence". The protein Latherin localization is believed to be Secreted.

As noted above, cluster AY180924 features 1 transcript, which were listed in Table 1 above. This transcript encode for protein which is a variant of protein Latherin precursor (SEQ ID NO:280). A description of the variant protein according to the present invention is now provided.

Variant protein AY180924_PEA.sub.--1_P3 (SEQ ID NO:281) according to the present invention has an amino acid sequence as given at the end of the application; it is encoded by transcript(s) AY180924_PEA.sub.--1_T1 (SEQ ID NO:276). An alignment is given to the known protein (Latherin precursor (SEQ ID NO:280)) at the end of the application. One or more alignments to one or more previously published protein sequences are given at the end of the application. A brief description of the relationship of the variant protein according to the present invention to each such aligned protein is as follows:

Comparison report between AY180924_PEA.sub.--1_P3 (SEQ ID NO:281) and LATH_HUMAN (SEQ ID NO:280):

1. An isolated chimeric polypeptide encoding for AY180924_PEA.sub.--1_P3 (SEQ ID NO:281), comprising a first amino acid sequence being at least 90% homologous to MLNVSGLFVLLCGLLVSSSAQEVLAGVSSQLLN corresponding to amino acids 1-33 of LATH_HUMAN (SEQ ID NO:280), which also corresponds to amino acids 1-33 of AY180924_PEA.sub.--1_P3 (SEQ ID NO:281), and a second amino acid sequence being at least 70%, optionally at least 80%, preferably at least 85%, more preferably at least 90% and most preferably at least 95% homologous to a polypeptide having the sequence GETVLLWVMQNPEPMPVKFS-LAKYLGHNEHY (SEQ ID NO:971) corresponding to amino acids 34-64 of AY180924_PEA.sub.--1_P3 (SEQ ID NO:281), wherein said first and second amino acid sequences are contiguous and in a sequential order.

2. An isolated polypeptide encoding for a tail of AY180924_PEA.sub.--1_P3 (SEQ ID NO:281) comprising a polypeptide being at least 70%, optionally at least about 80%, preferably at least about 85%, more preferably at least about 90% and most preferably at least about 95% homologous to the sequence GETVLLWVMQNPEPMPVKFSLAKYLGH-NEHY (SEQ ID NO:971) in AY180924_PEA.sub.--1_P3 (SEQ ID NO:281).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AY180924_PEA.sub.--1_P3 (SEQ ID NO:281) is encoded by the following transcript(s): AY180924_PEA.sub.--1_T1 (SEQ ID NO:276), for which the sequence(s) is/are given at the end of the application. The coding portion of transcript AY180924_PEA.sub.--1_T1 (SEQ ID NO:276) is shown in bold; this coding portion starts at position 73 and ends at position 264. The transcript also has the following SNPs as listed in Table 4 (given according to their position on the nucleotide sequence, with the alternative nucleic acid listed; the last column indicates whether the SNP is known or not; the presence of known SNPs in variant protein AY180924_PEA.sub.--1_P3 (SEQ ID NO:281) sequence provides support for the deduced sequence of this variant protein according to the present invention). TABLE-US-00537 TABLE 4 Nucleic acid SNPs SNP position on nucleotide Alternative Previously known sequence nucleic acid SNP? 361 C→T Yes 459 C→A Yes As noted above, cluster AY180924 features 3 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster AY180924_PEA.sub.--1_node.sub.--3 (SEQ ID NO:277) according to the present invention is supported by 2 libraries. The number of libraries was determined as previously described. This segment can be found in the following transcript(s): AY180924_PEA.sub.--1_T1 (SEQ ID NO:276). Table 5 below describes the starting and ending position of this segment on each transcript. TABLE-US-00538 TABLE 5 Segment location on transcripts Segment Segment Transcript name starting position ending position AY180924_PEA__1_T1 173 657 (SEQ ID NO: 276)

According to an optional embodiment of the present invention, short segments related to the above cluster are also provided. These segments are up to about 120 bp in length, and so are included in a separate description.

Segment cluster AY180924_PEA.sub.--1_node.sub.--0 (SEQ ID NO:278) according to the present invention is supported by 2 libraries. The number of libraries was determined as previously described. This segment can be found in the following transcript(s): AY180924_PEA.sub.--1_T1 (SEQ ID NO:276). Table 6 below describes the starting and ending position of this segment on each transcript. TABLE-US-00539 TABLE 6 Segment location on transcripts Segment Segment Transcript name starting position ending position AY180924_PEA__1_T1 1 58 (SEQ ID NO: 276)

Segment cluster AY180924_PEA.sub.--1_node.sub.--2 (SEQ ID NO:279) according to the present invention is supported by 2 libraries. The number of libraries was determined as previously described. This segment can be found in the following transcript(s): AY180924_PEA.sub.--1_T1 (SEQ ID NO:276). Table 7 below describes the starting and ending position of this segment on each transcript. TABLE-US-00540 TABLE 7 Segment location on transcripts Segment Transcript name starting position Segment ending position AY180924_PEA__1_T1 59 172 (SEQ ID NO: 276)

Variant protein alignment to the previously known protein:
Sequence name: /tmp/FepOCusBjG/YVh7Ev127H:LATH_HUMAN (SEQ ID NO:280)
Sequence documentation:
Alignment of: AY180924_PEA.sub.--1_P3 (SEQ ID NO:281).times.LATH_HUMAN (SEQ ID NO:280).
Alignment segment 1/1: TABLE-US-00541 Quality: 300.00 Escore: 0 Matching length: 33 Total length: 33 Matching Percent 100.00 Matching Percent Identity: 100.00 Similarity: Total Percent 100.00 Total Percent Identity: 100.00 Similarity: Gaps: 0
Alignment: TABLE-US-00542 1 MLNVSGLFVLLCGLLVSSSAQEVLAGVSSQLLN 33 |||||||||||||||||||||||||||||||| 1 MLNVSGLFVLLCGLLVSSSAQEVLAGVSSQLLN 33

Description for Cluster R75793

Cluster R75793 features 3 transcript(s) and 9 segment(s) of interest, the names for which are given in Tables 1 and 2, respectively, the sequences themselves are given at the end of the application. The selected protein variants are given in table 3. TABLE-US-00543 TABLE 1 Transcripts of interest Transcript Name Sequence ID No. R75793_PEA__1_T1 282 R75793_PEA__1_T3 283 R75793_PEA__1_T5 284

TABLE-US-00544 TABLE 2 Segments of interest Segment Name Sequence ID No. R75793_PEA__1_node__0 285 R75793_PEA__1_node__9 286 R75793_PEA__1_node__11 287 R75793_PEA__1_node__14 288 R75793_PEA__1_node__4 289 R75793_PEA__1_node__5 290 R75793_PEA__1_node__6 291 R75793_PEA__1_node__8 292 R75793_PEA__1_node__13 293

TABLE-US-00545 TABLE 3 Proteins of interest Sequence Protein Name ID No. Corresponding Transcript(s) R75793_PEA__1_P2 295 R75793_PEA__1_T1 (SEQ ID NO: 282) R75793_PEA__1_P5 296 R75793_PEA__1_T5 (SEQ ID NO: 284) R75793_PEA__1_P6 297 R75793_PEA__1_T3 (SEQ ID NO: 283)

Cluster R75793 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 31 refer to weighted expression of ESTs in each category, as "parts per million" (ratio of the expression of ESTs for a particular cluster to the expression of all ESTs in that category, according to parts per million).

Figure 31:
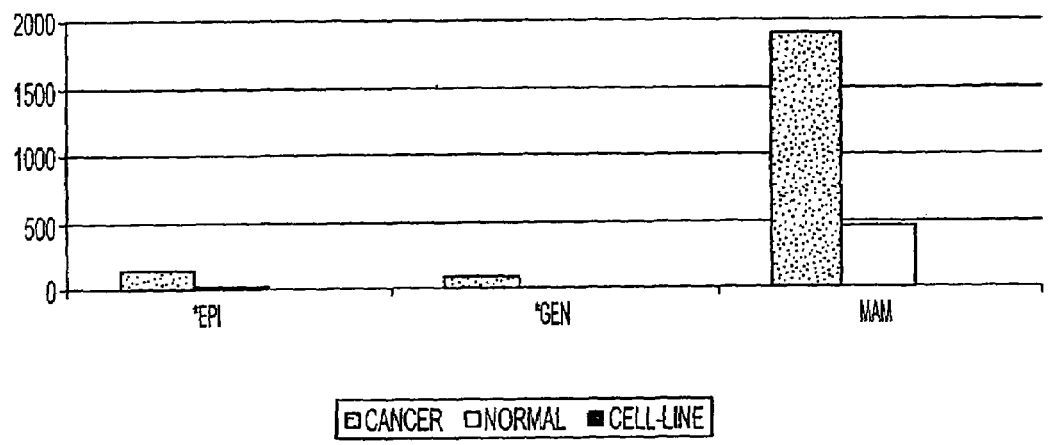
FIG. 31 is a histogram showing Cancer and cell-line vs. normal tissue expression for Cluster R75793, demonstrating overexpression in epithelial malignant tumors and a mixture of malignant tumors from different tissues.

Overall, the following results were obtained as shown with regard to the histograms in FIG. 31 and Table 4. This cluster is overexpressed (at least at a minimum level) in the following pathological conditions: epithelial malignant tumors and a mixture of malignant tumors from different tissues. TABLE-US-00546 TABLE 4 Normal tissue distribution Name of Tissue Number epithelial 16 general 5 Breast 457

TABLE-US-00547 TABLE 5 P values and ratios for expression in cancerous tissue Name of Tissue P1 P2 SP1 R3 SP2 R4 epithelial 3.3e-01 5.0e-01 9.2e-17 4.0 2.7e-07 2.0 general 1.3e-01 2.0e-01 3.4e-33 8.0 2.0e-17 3.9 Breast 5.9e-01 7.1e-01 1.2e-07 2.1 1.4e-02 1.0

As noted above, cluster R75793 features 3 transcript(s), which were listed in Table 1 above. A description of each variant protein according to the present invention is now provided.

Variant protein R75793_PEA.sub.--1_P2 (SEQ ID NO:295) according to the present invention has an amino acid sequence as given at the end of the application; it is encoded by transcript(s) R75793_PEA.sub.--1_T1 (SEQ ID NO:282). One or more alignments to one or more previously published protein sequences are given at the end of the application. A brief description of the relationship of the variant protein according to the present invention to each such aligned protein is as follows:

Comparison report between R75793_PEA.sub.--1_P2 (SEQ ID NO:295) and Q96DR8 (SEQ ID NO: 294):

1. An isolated chimeric polypeptide encoding for R75793_PEA.sub.--1_P2 (SEQ ID NO:295), comprising a first amino acid sequence being at least 90% homologous to MKFLAVLVLLGVSIFLVSAQNPTTAA-PADTYPATGPADDEAPDAETTAAATTATTAAPT TAT-TAASTTARKDIP corresponding to amino acids 1-74 of Q96DR8 (SEQ ID NO:294), which also corresponds to amino acids 1-74 of R75793_PEA.sub.--1_P2 (SEQ ID NO:295), and a second amino acid sequence being at least 70%, optionally at least 80%, preferably at least 85%, more preferably at least 90% and most preferably at least 95% homologous to a polypeptide having the sequence AP corresponding to amino acids 75-76 of R75793_PEA.sub.--1_P2 (SEQ ID NO:295), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R75793_PEA.sub.--1_P2 (SEQ ID NO:295) is encoded by the following transcript(s): R75793_PEA.sub.--1_T1 (SEQ ID NO:282), for which the sequence(s) is/are given at the end of the application. The coding portion of transcript R75793_PEA.sub.--1_T1 (SEQ ID NO:282) is shown in bold; this coding portion starts at position 69 and ends at position 296. The transcript also has the following SNPs as listed in Table 6 (given according to their position on the nucleotide sequence, with the alternative nucleic acid listed; the last column indicates whether the SNP is known or not; the presence of known SNPs in variant protein R75793_PEA.sub.--1_P2 (SEQ ID NO:295) sequence provides support for the deduced sequence of this variant protein according to the present invention). TABLE-US-00548 TABLE 6 Nucleic acid SNPs SNP position on Alternative Previously nucleotide sequence nucleic acid known SNP? 15 C→A Yes 59 G→T Yes 179 T→C No 179 T→G No 227 G→A Yes 516 A→T No Variant protein R75793_PEA.sub.--1_P5 (SEQ ID NO:296) according to the present invention has an amino acid sequence as given at the end of the application; it is encoded by transcript(s) R75793_PEA.sub.--1_T5 (SEQ ID NO:284). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R75793_PEA.sub.--1_P5 (SEQ ID NO:296) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein R75793_PEA.sub.--1_P5 (SEQ ID NO:296) sequence provides support for the deduced sequence of this variant protein according to the present invention). TABLE-US-00549 TABLE 7 Amino acid mutations SNP position(s) on Alternative Previously amino acid sequence amino acid(s) known SNP? 54 H→R Yes Variant protein R75793_PEA.sub.--1_P5 (SEQ ID NO:296) is encoded by the following transcript(s): R75793_PEA.sub.--1_T5 (SEQ ID NO:284), for which the sequence(s) is/are given at the end of the application. The coding portion of transcript R75793_PEA.sub.--1_T5 (SEQ ID NO:284) is shown in bold; this coding portion starts at position 69 and ends at position 383. The transcript also has the following SNPs as listed in Table 8 (given according to their position on the nucleotide sequence, with the alternative nucleic acid listed; the last column indicates whether the SNP is known or not; the presence of known SNPs in variant protein R75793_PEA.sub.--1_P5 (SEQ ID NO:296) sequence provides support for the deduced sequence of this variant protein according to the present invention). TABLE-US-00550 TABLE 8 Nucleic acid SNPs SNP position on Alternative Previously nucleotide sequence nucleic acid known SNP? 15 C→A Yes 59 G→T Yes 229 A→G Yes Variant protein R75793_PEA.sub.--1_P6 (SEQ ID NO:297) according to the present invention has an amino acid sequence as given at the end of the application; it is encoded by transcript(s) R75793_PEA.sub.--1_T3 (SEQ ID NO:283). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R75793_PEA.sub.--1_P6 (SEQ ID NO:297) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein R75793_PEA.sub.--1_P6 (SEQ ID NO:297) sequence provides support for the deduced sequence of this variant protein according to the present invention). TABLE-US-00551 TABLE 9 Amino acid mutations SNP position(s) on Alternative Previously amino acid sequence amino acid(s) known SNP? 16 R→Q Yes Variant protein R75793_PEA.sub.--1_P6 (SEQ ID NO:297) is encoded by the following transcript(s): R75793_PEA.sub.--1_T3 (SEQ ID NO:283), for which the sequence(s) is/are given at the end of the application. The coding portion of transcript R75793_PEA.sub.--1_T3 (SEQ ID NO:283) is shown in bold; this coding portion starts at position 329 and ends at position 502. The transcript also has the following SNPs as listed in Table 10 (given according to their position on the nucleotide sequence, with the alternative nucleic acid listed; the last column indicates whether the SNP is known or not; the presence of known SNPs in variant protein R75793_PEA.sub.--1_P6 (SEQ ID NO:297) sequence provides support for the deduced sequence of this variant protein according to the present invention). TABLE-US-00552 TABLE 10 Nucleic acid SNPs SNP position on Alternative Previously nucleotide sequence nucleic acid known SNP? 327 T→C No 327 T→G No 375 G→A Yes 635 A→T No As noted above, cluster R75793 features 9 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster R75793_PEA.sub.--1_node.sub.--0 (SEQ ID NO:285) according to the present invention is supported by 2 libraries. The number of libraries was determined as previously described. This segment can be found in the following transcript(s): R75793_PEA.sub.--1_T3 (SEQ ID NO:283). Table 11 below describes the starting and ending position of this segment on each transcript. TABLE-US-00553 TABLE 11 Segment location on transcripts Segment Segment starting ending Transcript name position position R75793_PEA__1_T3 (SEQ ID NO: 283) 1 274

Segment cluster R75793_PEA.sub.--1_node.sub.--9 (SEQ ID NO:286) according to the present invention is supported by 1 libraries. The number of libraries was determined as previously described. This segment can be found in the following transcript(s): R75793_PEA.sub.--1_T5 (SEQ ID NO:284). Table 12 below describes the starting and ending position of this segment on each transcript. TABLE-US-00554 TABLE 12 Segment location on transcripts Segment Segment starting ending Transcript name position position R75793_PEA__1_T5 (SEQ ID NO: 284) 169 491

Segment cluster R75793_PEA.sub.--1_node.sub.--11 (SEQ ID NO:287) according to the present invention is supported by 59 libraries. The number of libraries was determined as previously described. This segment can be found in the following transcript(s): R75793_PEA.sub.--1_T1 (SEQ ID NO:282) and R75793_PEA.sub.--1_T3 (SEQ ID NO:283). Table 13 below describes the starting and ending position of this segment on each transcript. TABLE-US- 00555 TABLE 13 Segment location on transcripts Segment Segment starting ending Transcript name position position R75793_PEA_1_T1 (SEQ ID NO: 282) 169 291 R75793_PEA_1_T3 (SEQ ID NO: 283) 317 439

Segment cluster R75793_PEA.sub.--1_node.sub.--14 (SEQ ID NO:288) according to the present invention is supported by 41 libraries. The number of libraries was determined as previously described. This segment can be found in the following transcript(s): R75793_PEA.sub.--1_T1 (SEQ ID NO:282) and R75793_PEA.sub.--1_T3 (SEQ ID NO:283). Table 14 below describes the starting and ending position of this segment on each transcript. TABLE-US-00556 TABLE 14 Segment location on transcripts Segment Segment starting ending Transcript name position position R75793_PEA_1_T1 (SEQ ID NO: 282) 321 527 R75793_PEA_1_T3 (SEQ ID NO: 283) 440 646

According to an optional embodiment of the present invention, short segments related to the above cluster are also provided. These segments are up to about 120 bp in length, and so are included in a separate description.

Segment cluster R75793_PEA.sub.--1_node.sub.--4 (SEQ ID NO:289) according to the present invention is supported by 46 libraries. The number of libraries was determined as previously described. This segment can be found in the following transcript(s): R75793_PEA.sub.--1_T1 (SEQ ID NO:282) and R75793_PEA.sub.--1_T5 (SEQ ID NO:284). Table 15 below describes the starting and ending position of this segment on each transcript. TABLE-US-00557 TABLE 15 Segment location on transcripts Segment Segment starting ending Transcript name position position R75793_PEA_1_T1 (SEQ ID NO: 282) 1 41 R75793_PEA_1_T5 (SEQ ID NO: 284) 1 41

Segment cluster R75793_PEA.sub.--1_node.sub.--5 (SEQ ID NO:290) according to the present invention is supported by 52 libraries. The number of libraries was determined as previously described. This segment can be found in the following transcript(s): R75793_PEA.sub.--1_T1 (SEQ ID NO:282) and R75793_PEA.sub.--1_T5 (SEQ ID NO:284). Table 16 below describes the starting and ending position of this segment on each transcript. TABLE-US-00558 TABLE 16 Segment location on transcripts Segment Segment starting ending Transcript name position position R75793_PEA_1_T1 (SEQ ID NO: 282) 42 74 R75793_PEA_1_T5 (SEQ ID NO: 284) 42 74

Segment cluster R75793_PEA.sub.--1_node.sub.--6 (SEQ ID NO:291) according to the present invention is supported by 54 libraries. The number of libraries was determined as previously described. This segment can be found in the following transcript(s): R75793_PEA.sub.--1_T1 (SEQ ID NO:282) and R75793_PEA.sub.--1_T5 (SEQ ID NO:284). Table 17 below describes the starting and ending position of this segment on each transcript. TABLE-US-00559 TABLE 17 Segment location on transcripts Segment Segment starting ending Transcript name position position R75793_PEA_1_T1 (SEQ ID NO: 282) 75 126 R75793_PEA_1_T5 (SEQ ID NO: 284) 75 126

Segment cluster R75793_PEA.sub.--1_node.sub.--8 (SEQ ID NO:292) according to the present invention is supported by 57 libraries. The number of libraries was determined as previously described. This segment can be found in the following transcript(s): R75793_PEA.sub.--1_T1 (SEQ ID NO:282), R75793_PEA.sub.--1_T3 (SEQ ID NO:283) and R75793_PEA1_T5 (SEQ ID NO:284). Table 18 below describes the starting and ending position of this segment on each transcript. TABLE-US-00560 TABLE 18 Segment location on transcripts Segment Segment starting ending Transcript name position position R75793_PEA_1_T1 (SEQ ID NO: 282) 127 168 R75793_PEA_1_T3 (SEQ ID NO: 283) 275 316 R75793_PEA_1_T5 (SEQ ID NO: 284) 127 168

Segment cluster R75793_PEA.sub.--1_node.sub.--13 (SEQ ID NO:293) according to the present invention is supported by 2 libraries. The number of libraries was determined as previously described. This segment can be found in the following transcript(s): R75793_PEA.sub.--1_T1 (SEQ ID NO:282). Table 19 below describes the starting and ending position of this segment on each transcript. TABLE-US-00561 TABLE 19 Segment location on transcripts Segment Segment starting ending Transcript name position position R75793_PEA_1_T1 (SEQ ID NO: 282) 292 320

Variant protein alignment to the previously known protein:

Sequence name: Q96DR8 (SEQ ID NO:294)

Sequence documentation:

Alignment of: R75793_PEA.sub.--1_P2 (SEQ ID NO:295).times.Q96DR8 (SEQ ID NO:294).

Alignment segment 1/1: TABLE-US-00562 Quality: 681.00 Escore: 0 Matching length: 74 Total length: 74 Matching Percent 100.00 Matching Percent Identity: 100.00 Similarity: Total Percent 100.00 Total Percent Identity: 100.00 Similarity: Gaps: 0

```
Alignment: TABLE-US-00563 . . . 1
MKFLAVLVLLGVSIFLVSAQNPTTAAPADTYPATGPADDEAPDAETTAAA  50
|||||||||||||||||||||||||||||||||||||||||||||||||  51
MKFLAVLVLLGVSIFLVSAQNPTTAAPADTYPATGPADDEAPDAETTAAA  50 . . . 51

TTATTAAPTTATTAASTTARKDIP                            74
||||||||||||||||||||||||                            51
TTATTAAPTTATTAASTTARKDIP                            74
```

Expression of Homo Sapiens Small Breast Epithelial Mucin (LOC118430) R75793 Transcripts which are Detectable by Amplicon as Depicted in Sequence Name R75793 junc11-13 (SEQ ID NO:881) in Normal and Cancerous Breast Tissues Expression of Homo sapiens small breast epithelial mucin (LOC118430) transcripts detectable by or according to junc11-13, R75793 junc11-13 (SEQ ID NO:881) amplicon(s) and primers R75793 junc11-13F (SEQ ID NO:879) and R75793 junc11-13R (SEQ ID NO:880) was measured by real time PCR. In parallel the expression of four housekeeping genes—PBGD (GenBank Accession No. BC.019323 (SEQ ID NO:926); amplicon—PBGD-amplicon (SEQ ID NO:929)), HPRT1 (GenBank Accession No. NM.sub.--000194 (SEQ ID NO:930); amplicon—HPRT1-amplicon (SEQ ID NO:933)), SDHA (GenBank Accession No. NM.sub.--004168 (SEQ ID NO:922); amplicon—SDHA-amplicon (SEQ ID NO:925)) and G6PD. (GenBank Accession No. NM.sub.--000402 (SEQ ID NO:918); G6PD-amplicon (SEQ ID NO:921), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 1: Tissue samples in testing panel, above), to obtain a value of fold differential expression for each sample relative to median of the normal PM samples.

In one experiment that was carried out no differential expression in the cancerous samples relative to the normal PM samples was observed. However, this may be due to a failure of this particular experiment.

Primer pairs are also optionally and preferably encompassed within the present invention; for example, for the above experiment, the following primer pair was used as a non-limiting illustrative example only of a suitable primer pair: R75793 junc11-13F forward primer (SEQ ID NO:879); and R75793 junc11-13R reverse primer (SEQ ID NO:880).

The present invention also preferably encompasses any amplicon obtained through the use of any suitable primer pair; for example, for the above experiment, the following amplicon was obtained as a non-limiting illustrative example only of a suitable amplicon: R75793 junc11-13 (SEQ ID NO:881). TABLE-US-00564 Forward primer R75793 junc11-13F (SEQ ID NO:879): TGATGATGAAGCCCCT-GATG Reverse primer R75793 junc11-13R (SEQ ID NO:880): TATTGTCAAGGGGCTGGAATGT Amplicon R75793junc11-13 (SEQ ID NO:881): TGATGATGAAGC-CCCTGATGCTGAAACCACTGCTGCTG-CAACCACTGCGA CCACTGCTGCTCCTACCACTG-CAACCACCGCTGCTTCTACCACTGCTCGT AAAGACATTCCAGCCCCTTGACAATA Expression of Homo Sapiens Small Breast Epithelial Mucin (LOC118430) R75793 Transcripts which are Detectable by Amplicon as Depicted in Sequence Name R75793 seg9 (SEQ ID NO:884) in Normal and Cancerous Breast Tissues Expression of Homo sapiens small breast epithelial mucin (LOC118430) transcripts detectable by or according to seg9, R75793seg9 (SEQ ID NO:884) amplicon(s) and primers R75793 seg9F (SEQ ID NO:882) and R75793seg9R (SEQ ID NO:883) was measured by real time PCR. In parallel the expression of four housekeeping genes—PBGD (GenBank Accession No. BC019323 (SEQ ID NO:926); amplicon—PBGD-amplicon (SEQ ID NO:929)), HPRT1 (GenBank Accession No. NM.sub.--000194 (SEQ ID NO:930); amplicon—HPRT1-amplicon (SEQ ID NO:933)), SDHA (GenBank Accession No. NM.sub.--004168 (SEQ ID NO:922); amplicon—SDHA-amplicon (SEQ ID NO:925)) and G6PD (GenBank Accession No. NM.sub.--000402 (SEQ ID NO:918); G6PD-amplicon (SEQ ID NO:921)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 1: Tissue samples in testing panel, above), to obtain a value of fold differential expression for each sample relative to median of the normal PM samples.

In one experiment that was carried out no differential expression in the cancerous samples relative to the normal PM samples was observed. However, this may be due to a failure of this particular experiment.

Primer pairs are also optionally and preferably encompassed within the present invention; for example, for the above experiment, the following primer pair was used as a non-limiting illustrative example only of a suitable primer pair: R75793seg9F forward primer (SEQ ID NO:882); and R75793seg9R reverse primer (SEQ ID NO:883).

The present invention also preferably encompasses any amplicon obtained through the use of any suitable primer pair; for example, for the above experiment, the following amplicon was obtained as a non-limiting illustrative example only of a suitable amplicon: R75793seg9 (SEQ ID NO:884). TABLE-US-00565 Forward primer R75793seg9F (SEQ ID NO:882): TCCAGCTTTAACCATTTTTCACTTC Reverse primer R75793seg9R (SEQ ID NO:883): GCTTTCACA-GACTTTTGCTTAGGATT Amplicon R75793seg9 (SEQ ID NO:884): TCCAGCAATAACCATTTTTCACTTC-CAGCCTCATGTCAAACAGCCAGTTT CCATGTGGAT-AGTCTTTGTTATTTGGTTTCCTTTG-CAAAAGTCTGTGAAA GC Description for Cluster HUMCA1XIA Cluster HUMCA1XIA features 4 transcript(s) and 46 segment(s) of interest, the names for which are given in Tables 1 and 2, respectively, the sequences themselves are given at the end of the application. The selected protein variants are given in table 3. TABLE-US-00566 TABLE 1 Transcripts of interest Transcript Name Sequence ID No. HUMCA1XIA_T16 298 HUMCA1XIA_T17 299 HUMCA1XIA_T19 300 HUMCA1XIA_T20 301

TABLE-US-00567 TABLE 2 Segments of interest Segment Name Sequence ID No. HUMCA1XIA_node_0 302 HUMCA1XIA_node_2 303 HUMCA1XIA_node_4 304 HUMCA1XIA_node_6 305 HUMCA1XIA_node_8 306 HUMCA1XIA_node_9 307 HUMCA1XIA_node_18 308 HUMCA1XIA_node_54 309 HUMCA1XIA_node_55 310 HUMCA1XIA_node_92 311 HUMCA1XIA_node_11 312 HUMCA1XIA_node_15 313 HUMCA1XIA_node—19 314 HUMCA1XIA_node_21 315 HUMCA1XIA_node_23 316 HUMCA1XIA_node_25 317 HUMCA1XIA_node_27 318 HUMCA1XIA_node_29 319 HUMCA1XIA_node_31 320 HUMCA1XIA_node_33 321 HUMCA1XIA_node_35 322 HUMCA1XIA_node_37 323 HUMCA1XIA_node_39 324 HUMCA1XIA_node_41 325 HUMCA1XIA_node_43 326 HUMCA1XIA_node_45 327 HUMCA1XIA_node_47 328 HUMCA1XIA_node_49 329 HUMCA1XIA_node_51 330 HUMCA1XIA_node_57 331 HUMCA1XIA_node_59 332 HUMCA1XIA_node_62 333 HUMCA1XIA_node_64 334 HUMCA1XIA_node_66 335 HUMCA1XIA_node_68 336 HUMCA1XIA_node_70 337 HUMCA1XIA_node_72 338 HUMCA1XIA_node_74 339 HUMCA1XIA_node_76 340 HUMCA1XIA_node_78 341 HUMCA1XIA_node_81 342 HUMCA1XIA_node_83 343 HUMCA1XIA_node_85 344 HUMCA1XIA_node_87 345 HUMCA1XIA_node_89 346 HUMCA1XIA_node_91 347

TABLE-US-00568 TABLE 3 Proteins of interest Sequence Protein Name ID No. Corresponding Transcript(s) HUMCA1XIA_P14 350 HUMCA1XIA_T16 (SEQ ID NO:298) HUMCA1XIA_P15 351 HUMCA1XIA_T17 (SEQ ID NO:299) HUMCA1XIA_P16 352 HUMCA1XIA_T19 (SEQ ID NO:300) HUMCA1XIA_P17 353 HUMCA1XIA_T20 (SEQ ID NO:301)

These sequences are variants of the known protein Collagen alpha 1 (SEQ ID NO:348) (SwissProt accession identifier CA1B_HUMAN; known also according to the synonyms XI), SEQ ID NO:348, referred to herein as the previously known protein.

Protein Collagen alpha 1 (SEQ ID NO:348) is known or believed to have the following function(s): May play an important role in fibrillogenesis by controlling lateral growth of collagen II fibrils. The sequence for protein Collagen alpha 1 (SEQ ID NO:348) is given at the end of the application, as "Collagen alpha 1 (SEQ ID NO:348) amino acid sequence". Known polymorphisms for this sequence are as shown in Table 4. TABLE-US-00569 TABLE 4 Amino acid mutations for Known Protein SNP position(s) on amino acid sequence Comment 625 G→V (in STL2). /FTId=VAR_013583. 676 G→R (in STL2; overlapping phenotype with Marshall syndrome). /FTId=VAR_013584. 921-926 Missing (in STL2; overlapping phenotype with Marshall syndrome). /FTId=VAR_013585. 1313-1315 Missing (in STL2; overlapping phenotype with Marshall syndrome). /FTId=VAR_013586. 1516 G→V (in STL2; overlapping phenotype with Marshall syndrome). /FTId=VAR_013587. 941-944 KDGL→RMGC 986 Y→H 1074 R→P 1142 G→D 1218 M→W 1758 T→A 1786 S→N The following GO Annotation(s) apply to the previously known protein. The following annotation(s) were found: cartilage condensation; vision; hearing; cell-cell adhesion; extracellular matrix organization and biogenesis, which are annotation(s) related to Biological Process; extracellular matrix structural protein; extracellular matrix protein, adhesive, which are annotation(s) related to Molecular Function; and extracellular matrix; collagen; collagen type XI, which are annotation(s) related to Cellular Component.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster HUMCA1XIA can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 32 refer to weighted expression of ESTs in each category, as "parts per million" (ratio of the expression of ESTs for a particular cluster to the expression of all ESTs in that category, according to parts per million).

Figure 32:
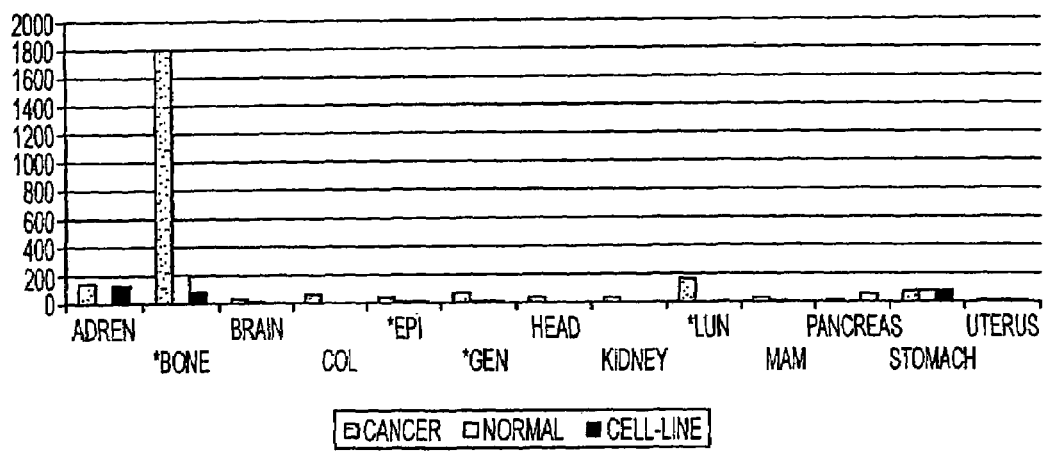
FIG. 32 is a histogram showing Cancer and cell-line vs. normal tissue expression for Cluster HUMCA1XIA, demonstrating overexpression in bone malignant tumors, epithelial malignant tumors, a mixture of malignant tumors from different tissues and lung malignant tumors.

Overall, the following results were obtained as shown with regard to the histograms in FIG. 32 and Table 5. This cluster is overexpressed (at least at a minimum level) in the following pathological conditions: bone malignant tumors, epithelial malignant tumors, a mixture of malignant tumors from different tissues and lung malignant tumors. TABLE-US-00570 TABLE 5 Normal tissue distribution Name of Tissue Number Adrenal 0 Bone 207 Brain 13 Colon 0 epithelial 11 general 11 head and neck 0 kidney 0 Lung 0 Breast 8 pancreas 0 stomach 73 Uterus 9

TABLE-US-00571 TABLE 6 P values and ratios for expression in cancerous tissue Name of Tissue P1 P2 SP1 R3 SP2 R4 adrenal 4.2e-01 1.9e-01 9.6e-02 3.4 8.2e-02 3.6 Bone 2.4e-01 6.3e-01 7.7e-10 4.3 5.3e-03 1.6 Brain 5.0e-01 6.9e-01 1.8e-01 2.1 4.2e-01 1.3 Colon 1.3e-02 2.9e-02 2.4e-01 3.0 3.5e-01 2.4 epithelial 3.9e-04 3.2e-03 1.3e-03 2.3 1.8e-02 1.7 general 5.6e-05 1.6e-03 9.5e-17 4.5 1.1e-09 2.8 head and neck 1.2e-01 2.1e-01 11.3 11.1 kidney 6.5e-01 7.2e-01 3.4e-01 2.4 4.9e-01 1.9 Lung 5.3e-02 9.1e-02 5.5e-05 7.3 5.0e-03 4.0 Breast 4.3e-01 5.6e-01 6.9e-01 1.4 8.2e-01 1.1 pancreas 3.3e-01 1.8e-01 4.2e-01 2.4 1.5e-01 3.7 stomach 5.0e-01 6.1e-01 6.9e-01 1.0 6.7e-01 0.8 Uterus 7.1e-01 7.0e-01 6.6e-01 1.1 6.4e-01 1.1

As noted above, cluster HUMCA1XIA features 4 transcript(s), which were listed in Table 1 above. These transcript(s) encode for protein(s) which are variant(s) of protein Collagen alpha 1 (SEQ ID NO:348). A description of each variant protein according to the present invention is now provided.

Variant protein HUMCA1XIA_P14 (SEQ ID NO:350) according to the present invention has an amino acid sequence as given at the end of the application; it is encoded by transcript(s) HUMCA1XIA_T16 (SEQ ID NO:298). An alignment is given to the known protein (Collagen alpha 1 (SEQ ID NO:348)) at the end of the application. One or more alignments to one or more previously published protein sequences are given at the end of the application. A brief description of the relationship of the variant protein according to the present invention to each such aligned protein is as follows:

Comparison report between HUMCA1XIA_P14 (SEQ ID NO:350) and CA1B_HUMAN_V5 (SEQ ID NO: 349):

1. An isolated chimeric polypeptide encoding for HUMCA1XIA_P14 (SEQ ID NO:350), comprising a first amino acid sequence being at least 90% homologous to MEPWSSRWKTKRWLWDFTVTTLALTFLFQAREVRGAAPVDVLKALDFHNSPEGISKTT GFCTNRKNSKGSDTAYRVSKQAQLSAPTKQLFPGGTFPEDFSILFTVKPKKGIQSFLLSIY NEHGIQQIGVEVGRSPVFLFEDHTGKPAPEDYPLFRTVNIADGKWHRVAISVEKKTVTM IVDCKKKTTKPLDRSERAIVDTNGITVFGTRILDEEVFEGDIQQFLITGDPKAAYDYCEH YSPDCDSSAPKAAQAQEPQIDEYAPEDIIEYDYEYGEAEYKEAESVTEGPTVTEETIAQT EANIVDDFQEYNYGTMESYQTEAPRHVSGTNEPNPVEEIFTEEYLTGEDYDSQRKNSED TLYENKEIDGRDSDLLVDGDLGEYDFYEYKEYEDKPTSPPNEEFGPGVPAETDITETSIN GHGAYGEKGQKGEPAVVEPGMLVEGPPGPAGPAGIMGPPGLQGPTGPPGDPGDRGPPG RPGLPGADGLPGPPGTMLMLPFRYGGDGSKGPTISAQEAQAQAILQQARIALRGPPGPM GLTGRPGPVGGPGSSGAKGESGDPGPQGPRGVQGPPGPTGKPGKRGRPGADGGRGMP GEPGAKGDRGFDGLPGLPGDKGHRGERGPQGPPGPPGDDGMRGEDGEIGPRGLPGEAG PRGLLGPRGTPGAPGQPGMAGVDGPPGPKGNMGPQGEPGPPGQQGNPGPQGLPGPQG PIGPPGEKGPQGKPGLAGLPGADGPPGHPGKEGQSGEKGALGPPGPQGPIGYPGPRGVK GADGVRGLKGSKGEKGEDGFPGFKGDMGLKGDRGEVGQIGPRGEDGPEGPKGRAGPT GDPGPSGQAGEKGKLGVPGLPGYPGRQGPKGSTGFPGFPGANGEKGARGVAGKPGPR GQRGPTGPRGSRGARGPTGKPGPKGTSGGDGPPGPPGERGPQGPQGPVGFPGPKGPPGP PGKDGLPGHPGQRGETGFQGKTGPPGPGGWGPQGPTGETGPIGERGHPGPPGPPGEQG LPGMGKEGAKGDPGPQGISGKDGPAGLRGFPGERGLPGAQGAPGLKGGEGPQGPPGP V corresponding to amino acids 1-1056 of CA1B_HUMAN_V5 (SEQ ID NO:349), which also corresponds to amino acids 1-1056 of HUMCA1XIA_P14 (SEQ ID NO:350), and a second amino acid sequence being at least 70%, optionally at least 80%, preferably at least 85%, more preferably at least 90% and most preferably at least 95% homologous to a polypeptide having the sequence VSMMIINSQTIVVNYSSSFITLML (SEQ ID NO:972) corresponding to amino acids 1057-1081 of HUMCA1XIA_P14 (SEQ ID NO:350), wherein said first amino acid sequence and second amino acid sequence are contiguous and in a sequential order.

2. An isolated polypeptide encoding for a tail of HUMCA1XIA_P14 (SEQ ID NO:350), comprising a polypeptide being at least 70%, optionally at least about 80%, preferably at least about 85%, more preferably at least about 90% and most preferably at least about 95% homologous to the sequence VSMMIINSQTIMVVNYSSSFITLML (SEQ ID NO:972) in HUMCA1XIA_P14 (SEQ ID NO:350).

It should be noted that the known protein sequence (CA1B_HUMAN; SEQ ID NO:348) has one or more changes than the sequence given at the end of the application and named as being the amino acid sequence for CA1B_HUMAN_V5 (SEQ ID NO:349) (SEQ ID NO:349). These changes were previously known to occur and are listed in the table below. TABLE-US-00572 TABLE 7 Changes to CA1B_HUMAN_V5 (SEQ ID NO: 349) SNP position(s) on amino acid sequence Type of change 987 conflict The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCA1XIA_P14 (SEQ ID NO:350) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein HUMCA1XIA_P14 (SEQ ID NO:350) sequence provides support for the deduced sequence of this variant protein according to the present invention). TABLE-US-00573 TABLE 8 Amino acid mutations SNP position(s) on Alternative Previously amino acid sequence amino acid(s) known SNP? 8 W→G Yes 46 D→E Yes 559 G→S Yes 832 G→*Yes 986 H→Y Yes 1061I→M Yes 1070 V→A Yes Variant protein HUMCA1XIA_P14 (SEQ ID NO:350) is encoded by the following transcript(s): HUMCA1XIA_T16 (SEQ ID NO:298), for which the sequence(s) is/are given at the end of the application. The coding portion of transcript HUMCA1XIA_T16 (SEQ ID NO:298) is shown in bold; this coding portion starts at position 319 and ends at position 3561. The transcript also has the following SNPs as listed in Table 9 (given according to their position on the nucleotide sequence, with the alternative nucleic acid listed; the last column indicates whether the SNP is known or not; the presence of known SNPs in variant protein HUMCA1XIA_P14 (SEQ ID NO:350) sequence provides support for the deduced sequence of this variant protein according to the present invention). TABLE-US-00574 TABLE 9 Nucleic acid SNPs SNP position on Alternative Previously nucleotide sequence nucleic acid known SNP? 157 A→G No 241 T→A Yes 340 T→G Yes 456 T→G Yes 1993 G→A Yes 2812 G→T Yes 3274 C→T Yes 3282 C→T Yes 3501 A→G Yes 3527 T→C Yes Variant protein HUMCA1XIA_P15 (SEQ ID NO:351) according to the present invention has an amino acid sequence as given at the end of the application; it is encoded by transcript(s) HUMCA1XIA_T17 (SEQ ID NO:299). An alignment is given to the known protein (Collagen alpha 1 (SEQ ID NO:348)) at the end of the application. One or more alignments to one or more previously published protein sequences are given at the end of the application. A brief description of the relationship of the variant protein according to the present invention to each such aligned protein is as follows:

Comparison report between HUMCA1XIA_P15 (SEQ ID NO:351) and CA1B_HUMAN (SEQ ID NO:348):

1. An isolated chimeric polypeptide encoding for HUMCA1XIA_P15 (SEQ ID NO:351), comprising a first amino acid sequence being at least 90% homologous to MEPWSSRWKTKRWLWDFTVTTLALT-FLFQAREVRGMPVDVLKALDFHNSPEGISKTT GFCT-NRKNSKGSDTAYRVSKQAQLSAPTKQLFPGGTFPED FSILFTVKPKKGIQSFLLSIY NEHGIQQIGVEVGRSPV-FLFEDHTGKPAPEDYPLFRTVNIADGK-WHRVAISVEKKTVTM IVDCKKKTTKPLDRSE-RAIVDTNGITVFGTRILDEEVFEGDIQQFLITGDPKA AYDYCEH YSPDCDSSAPKAAQAQEPQIDEYAPEDI-IEYDYEYGEAEYKEAESVTEGPTVTEETIAQT EAN-IVDDFQEYNYGTMESYQTEAPRHVSGT-NEPNPVEEIFTEEYLTGEDYDSQRKNSED TLYENKEIDGRDSDLLVDGDLGEYD-FYEYKEYEDKPTSPPNEEFGPGVPAETDITETSIN GHGAYGEKGQKGEPAWEPGMLVEGPPG-PAGPAGIMGPPGLQGPTGPPGDPGDRGPPG RPGLP-GADGLPGPPGTMLMLPFRYGGDGSKGP-TISAQEAQAQAILQQARIALRGPPGPM GLTGRPGPVGGPGSSGAKGESGDPGPQG-PRGVQGPPGPTGKPGKRGRPGADGGRGMP GEP-GAKGDRGFDGLPGLPGDKGHRGERGPQG-PPGPPGDDGMRGEDGEIGPRGLPGEAG PRGLLGPRGTPGAPGQPGMAGVDGPPGP-KGNMGPQGEPGPPGQQGNPGPQGLPGPQG PIGP-PGEK corresponding to amino acids 1-714 of CA1B_HUMAN (SEQ ID NO:348), which also corresponds to amino acids 1-714 of HUMCA1XIA_P15 (SEQ ID NO:351), and a second amino acid sequence being at least 70%, optionally at least 80%, preferably at least 85%, more preferably at least 90% and most preferably at least 95% homologous to a polypeptide having the sequence MCCNLS-FGILIPLQK (SEQ ID NO:973) corresponding to amino acids 715-729 of HUMCA1XIA_P15 (SEQ ID NO:351), wherein said first amino acid sequence and second amino acid sequence are contiguous and in a sequential order.

2. An isolated polypeptide encoding for a tail of HUMCA1XIA_P15 (SEQ ID NO:351), comprising a polypeptide being at least 70%, optionally at least about 80%, preferably at least about 85%, more preferably at least about 90% and most preferably at least about 95% homologous to the sequence MCCNLSFGILIPLQK (SEQ ID NO:973) in HUMCA1XIA_P15 (SEQ ID NO:351).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCA1XIA_P15 (SEQ ID NO:351) also has the following non-silent SNPs (Single Nucleotide Polymorphisms) as listed in Table 10, (given according to their position(s) on the amino acid sequence, with the alternative amino acid(s) listed; the last column indicates whether the SNP is known or not; the presence of known SNPs in variant protein HUMCA1XIA_P15 (SEQ ID NO:351) sequence provides support for the deduced sequence of this variant protein according to the present invention). TABLE-US-00575 TABLE 10 Amino acid mutations SNP position(s) on Alternative Previously amino acid sequence amino acid(s) known SNP? 8 W→G Yes 46 D→E Yes 559 G→S Yes The glycosylation sites of variant protein HUMCA1XIA_P15 (SEQ ID NO:351), as compared to the known protein Collagen alpha 1 (SEQ ID NO:348), are described in Table 11 (given according to their position(s) on the amino acid sequence in the first column; the second column indicates whether the glycosylation site is present in the variant protein; and the last column indicates whether the position is different on the variant protein). TABLE-US-00576 TABLE 11 Glycosylation site(s) Position(s) on known Present in amino acid sequence variant protein? 1640 no Variant protein HUMCA1XIA_P15 (SEQ ID NO:351) is encoded by the following transcript(s): HUMCA1XIA_T17 (SEQ ID NO:299), for which the sequence(s) is/are given at the end of the application. The coding portion of transcript HUMCA1XIA_T17 (SEQ ID NO:299) is shown in bold; this coding portion starts at position 319 and ends at position 2505. The transcript also has the following SNPs as listed in Table 12 (given according to their position on the nucleotide sequence, with the alternative nucleic acid listed; the last column indicates whether the SNP is known or not; the presence of known SNPs in variant protein HUMCA1XIA_P15 (SEQ ID NO:351) sequence provides support for the deduced sequence of this variant protein according to the present invention). TABLE-US-00577 TABLE 12 Nucleic acid SNPs SNP position on Alternative Previously nucleotide sequence nucleic acid known SNP? 157 A→G No 241 T→A Yes 340 T→G Yes 456 T→G Yes 1993 G→A Yes 2473 C→T Yes Variant protein HUMCA1XIA P_16 (SEQ ID NO:352) according to the present invention has an amino acid sequence as given at the end of the application; it is encoded by transcript(s) HUMCA1XIA_T19 (SEQ ID NO:300). An alignment is given to the known protein (Collagen alpha 1 (SEQ ID NO:348)) at the end of the application. One or more alignments to one or more previously published protein sequences are given at the end of the application. A brief description of the relationship of the variant protein according to the present invention to each such aligned protein is as follows:

Comparison report between HUMCA1XIA_P16 (SEQ ID NO:352) and CA1B_HUMAN (SEQ ID NO:348):

1. An isolated chimeric polypeptide encoding for HUMCA1XIA_P16 (SEQ ID NO:352), comprising a first amino acid sequence being at least 90% homologous to MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIY NEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEH YSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSED TLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPG RPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMP GEPGAKGDRGFDGLPGLPGDKGHRGERGPQGPPGPPGDDGMRGEDGEIGPRGLPGEA corresponding to amino acids 1-648 of CA1B_HUMAN (SEQ ID NO:348), which also corresponds to amino acids 1-648 of HUMCA1XIA_P16 (SEQ ID NO:352), a second amino acid sequence being at least 90% homologous to GMAGVDGPPGPKGNMGPQGEPGPPGQQGNPGPQGLPGPQGPIGPPGEK corresponding to amino acids 667-714 of CA1B_HUMAN (SEQ ID NO:348), which also corresponds to amino acids 649-696 of HUMCA1XIA_P16 (SEQ ID NO:352), and a third amino acid sequence being at least 70%, optionally at least 80%, preferably at least 85%, more preferably at least 90% and most preferably at least 95% homologous to a polypeptide having the sequence VSFSFSLFYKKVIKFACDKRFVGRHDERKVVKLSLPLYLIYE (SEQ ID NO:974) corresponding to amino acids 697-738 of HUMCA1XIA_P16 (SEQ ID NO:352), wherein said first amino acid sequence, second amino acid sequence and third amino acid sequence are contiguous and in a sequential order.

2. An isolated chimeric polypeptide encoding for an edge portion of HUMCA1XIA_P16 (SEQ ID NO:352), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AG, having a structure as follows: a sequence starting from any of amino acid numbers 648-x to 648; and ending at any of amino acid numbers 649+((n-2)-x), in which x varies from 0 to n-2.

3. An isolated polypeptide encoding for a tail of HUMCA1XIA_P16 (SEQ ID NO:352), comprising a polypeptide being at least 70%, optionally at least about 80%, preferably at least about 85%, more preferably at least about 90% and most preferably at least about 95% homologous to the sequence VSFSFSLFYKKVIKFACDKRFVGRHDERKVVKLSLPLYLIYE (SEQ ID NO:974) in HUMCA1XIA_P16 (SEQ ID NO:352).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCA1XIA_P16 (SEQ ID NO:352) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein HUMCA1XIA_P16 (SEQ ID NO:352) sequence provides support for the deduced sequence of this variant protein according to the present invention). TABLE-US-00578 TABLE 13 Amino acid mutations SNP position(s) on Alternative Previously amino acid sequence amino acid(s) known SNP? 8 W→G Yes 46 D→E Yes 559 G→S Yes The glycosylation sites of variant protein HUMCA1XIA_P16 (SEQ ID NO:352), as compared to the known protein Collagen alpha 1 (SEQ ID NO:348), are described in Table 14 (given according to their position(s) on the amino acid sequence in the first column; the second column indicates whether the glycosylation site is present in the variant protein; and the last column indicates whether the position is different on the variant protein). TABLE-US-00579 TABLE 14 Glycosylation site(s) Position(s) on known Present in amino acid sequence variant protein? 1640 no Variant protein HUMCA1XIA_P16 (SEQ ID NO:352) is encoded by the following transcript(s): HUMCA1XIA_T19 (SEQ ID NO:300), for which the sequence(s) is/are given at the end of the application. The coding portion of transcript HUMCA1XIA_T19 (SEQ ID NO:300) is shown in bold; this coding portion starts at position 319 and ends at position 2532. The transcript also has the following SNPs as listed in Table 15 (given according to their position on the nucleotide sequence, with the alternative nucleic acid listed; the last column indicates whether the SNP is known or not; the presence of known SNPs in variant protein HUMCA1XIA_P16 (SEQ ID NO:352) sequence provides support for the deduced sequence of this variant protein according to the present invention). TABLE-US-00580 TABLE 15 Nucleic acid SNPs SNP position on Alternative Previously nucleotide sequence nucleic acid known SNP? 157 A→G No 241 T→A Yes 340 T→G Yes 456 T→G Yes 1993 G→A Yes 2606 C→A Yes 2677 T→G Yes 2849 C→T Yes Variant protein HUMCA1XIA_P17 (SEQ ID NO:353) according to the present invention has an amino acid sequence as given at the end of the application; it is encoded by transcript(s) HUMCA1XIA_T20 (SEQ ID NO:301). An alignment is given to the known protein (Collagen alpha 1 (SEQ ID NO:348)) at the end of the application. One or more alignments to one or more previously published protein sequences are given at the end of the application. A brief description of the relationship of the variant protein according to the present invention to each such aligned protein is as follows:

Comparison report between HUMCA1XIA_P17 (SEQ ID NO:353) and CA1B_HUMAN (SEQ ID NO:348):

1. An isolated chimeric polypeptide encoding for HUMCA1XIA_P17 (SEQ ID NO:353), comprising a first amino acid sequence being at least 90% homologous to MEPWSSRWKTKRWLWDFTVTTLALTFLFQAREVRGAAPVDVLKALDFHNSPEGISKTT GFCTNRKNSKGSDTAYRVSKQAQLSAPTKQLFPGGTFPEDFSILFTVKPKKGIQSFLLSIY NEHGIQQIGVEVGRSPVFLFEDHTGKPAPEDYPLFRTVNIADGKWHRVAISVEKKTVTM IVDCKKKTTKPLDRSERAIVDTNGITVFGTRILDEEVFEGDIQQFLITGDPKAAYDYCEH YSPDCDSSAPKAAQAQEPQIDE corresponding to amino acids 1-260 of CA1B_HUMAN (SEQ ID NO:348), which also corresponds to amino acids 1-260 of HUMCA1XIA_P17 (SEQ ID NO:353), and a second amino acid sequence being at least 70%, optionally at least 80%, preferably at least 85%, more preferably at least 90% and most preferably at least 95% homologous to a polypeptide having the sequence VRSTRPEKVFVFQ (SEQ ID NO:975) corresponding to amino acids 261-273 of HUMCA1XIA_P17 (SEQ ID NO:353), wherein said first amino acid sequence and second amino acid sequence are contiguous and in a sequential order.

2. An isolated polypeptide encoding for a tail of HUMCA1XIA_P17 (SEQ ID NO:353), comprising a polypeptide being at least 70%, optionally at least about 80%, preferably at least about 85%, more preferably at least about 90% and most preferably at least about 95% homologous to the sequence VRSTRPEKVFVFQ (SEQ ID NO:975) in HUMCA1XIA_P17 (SEQ ID NO:353).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCA1XIA_P17 (SEQ ID NO:353) also has the following non-silent SNPs (Single Nucleotide Polymorphisms) as listed in Table 16, (given according to their position(s) on the amino acid sequence, with the alternative amino acid(s) listed; the last column indicates whether the SNP is known or not; the presence of known SNPs in variant protein HUMCA1XIA_P17 (SEQ ID NO:353) sequence provides support for the deduced sequence of this variant protein according to the present invention). TABLE-US-00581 TABLE 16 Amino acid mutations SNP position(s) on Alternative Previously amino acid sequence amino acid(s) known SNP? 8 W→G Yes 46 D→E Yes The glycosylation sites of variant protein HUMCA1XIA_P17 (SEQ ID NO:353), as compared to the known protein Collagen alpha 1 (SEQ ID NO:348), are described in Table 17 (given according to their position(s) on the amino acid sequence in the first column; the second column indicates whether the glycosylation site is present in the variant protein; and the last column indicates whether the position is different on the variant protein). TABLE-US-00582 TABLE 17 Glycosylation site(s) Position(s) on known Present in Position in amino acid sequence variant protein? variant protein? 1640 no Variant protein HUMCA1XIA_P17 (SEQ ID NO:353) is encoded by the following transcript(s): HUMCA XIA_T20 (SEQ ID NO:301), for which the sequence(s) is/are given at the end of the application. The coding portion of transcript HUMCA1XIA_T20 (SEQ ID NO:301) is shown in bold; this coding portion starts at position 319 and ends at position 1137. The transcript also has the following SNPs as listed in Table 18 (given according to their position on the nucleotide sequence, with the alternative nucleic acid listed; the last column indicates whether the SNP is known or not; the presence of known SNPs in variant protein HUMCA1XIA_P17 (SEQ ID NO:353) sequence provides support for the deduced sequence of this variant protein according to the present invention). TABLE-US-00583 TABLE 18 Nucleic acid SNPs SNP position on Alternative Previously nucleotide sequence nucleic acid known SNP? 157 A→G No 241 T→A Yes 340 T→G Yes 456 T→G Yes 1150 A→C Yes As noted above, cluster HUMCA1XIA features 46 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMCA1XIA_node.sub.--0 (SEQ ID NO:302) according to the present invention is supported by 13 libraries. The number of libraries was determined as previously described. This segment can be found in the following transcript(s): HUMCA1XIA_T16 (SEQ ID NO:298), HUMCA1XIA_T17 (SEQ ID NO:299), HUMCA1XIA_T19 (SEQ ID NO:300) and HUMCA1XIA_T20 (SEQ ID NO:301). Table 19 below describes the starting and ending position of this segment on each transcript. TABLE-US-00584 TABLE 19 Segment location on transcripts Segment Transcript name starting position ending position HUMCA1XIA_T16 (SEQ ID NO:298) 1 424 HUMCA1XIA_T17 (SEQ ID NO:299) 1 424 HUMCA1XIA_T19 (SEQ ID NO:300) 1 424 HUMCA1XIA_T20 (SEQ ID NO:301) 1 424

Segment cluster HUMCA1XIA_node.sub.--2 (SEQ ID NO:303) according to the present invention is supported by 9 libraries. The number of libraries was determined as previously described. This segment can be found in the following transcript(s): HUMCA1XIA_T16 (SEQ ID NO:298), HUMCA1XIA_T17 (SEQ ID NO:299), HUMCA1XIA_T19 (SEQ ID NO:300) and HUMCA1XIA_T20 (SEQ ID NO:301). Table 20 below describes the starting and ending position of this segment on each transcript. TABLE-US-00585 TABLE 20 Segment location on transcripts Segment Segment Transcript name starting position ending position HUMCA1XIA_T16 (SEQ ID NO:298) 425 592 HUMCA1XIA_T17 (SEQ ID NO:299) 425 592 HUMCA1XIA_T19 (SEQ ID NO:300) 425 592 HUMCA1XIA_T20 (SEQ ID NO:301) 425 592

Segment cluster HUMCA1XIA_node.sub.--4 (SEQ ID NO:304) according to the present invention is supported by 5 libraries. The number of libraries was determined as previously described. This segment can be found in the following transcript(s): HUMCA1XIA_T16 (SEQ ID NO:298), HUMCA1XIA_T17 (SEQ ID NO:299), HUMCA1XIA_T19 (SEQ ID NO:300) and HUMCA1XIA_T20 (SEQ ID NO:301). Table 21 below describes the starting and ending position of this segment on each transcript. TABLE-US-00586 TABLE 21 Segment location on transcripts Segment Segment Transcript name starting position ending position HUMCA1XIA_T16 (SEQ ID NO:298) 593 806 HUMCA1XIA_T17 (SEQ ID NO:299) 593 806 HUMCA1XIA_T19 (SEQ ID NO:300) 593 806 HUMCA1XIA_T20 (SEQ ID NO:301) 593 806

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to breast cancer), shown in Table 22. TABLE-US-00587 TABLE 22 Oligonucleotides related to this segment Overexpressed Chip Oligonucleotide name in cancers reference HUMCA1XIA_0_18_0 breast malignant BRS (SEQ ID NO:904) tumors Segment cluster HUMCA1XIA_node.sub.--6 (SEQ ID NO:305) according to the present invention is supported by 5 libraries. The number of libraries was determined as previously described. This segment can be found in the following transcript(s): HUMCA1XIA_T16 (SEQ ID NO:298), HUMCA1XIA_T17 (SEQ ID NO:299), HUMCA1XIA_T19 (SEQ ID NO:300) and HUMCA1XIA_T20 (SEQ ID NO:301). Table 23 below describes the starting and ending position of this segment on each transcript. TABLE-US-00588 TABLE 23 Segment location on transcripts Segment Segment Transcript name starting position ending position HUMCA1XIA_T16 (SEQ ID NO:298) 807 969 HUMCA1XIA_T17 (SEQ ID NO:299) 807 969 HUMCA1XIA_T19 (SEQ ID NO:300) 807 969 HUMCA1XIA_T20 (SEQ ID NO:301) 807 969

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to breast cancer), shown in Table 24. TABLE-US-00589 TABLE 24 Oligonucleotides related to this segment Overexpressed Chip Oligonucleotide name in cancers reference HUMCA1XIA_0_18_0 breast malignant BRS (SEQ ID NO:904) tumors Segment cluster HUMCA1XIA_node.sub.--8 (SEQ ID NO:306) according to the present invention is supported by 5 libraries. The number of libraries was determined as previously described. This segment can be found in the following transcript(s): HUMCA1XIA_T16 (SEQ ID NO:298), HUMCA1XIA_T17 (SEQ ID NO:299), HUMCA1XIA_T19 (SEQ ID NO:300) and HUMCA1XIA_T20 (SEQ ID NO:301). Table 25 below describes the starting and ending position of this segment on each transcript. TABLE-US-00590 TABLE 25 Segment location on transcripts Segment Segment Transcript name starting position ending position HUMCA1XIA_T16 (SEQ ID NO:298) 970 1098 HUMCA1XIA_T17 (SEQ ID NO:299) 970 1098 HUMCA1XIA_T19 (SEQ ID NO:300) 970 1098 HUMCA1XIA_T20 (SEQ ID NO:301) 970 1098

Segment cluster HUMCA1XIA_node.sub.--9 (SEQ ID NO:307) according to the present invention is supported by 2 libraries. The number of libraries was determined as previously described. This segment can be found in the following transcript(s): HUMCA1XIA_T20 (SEQ ID NO:301). Table 26 below describes the starting and ending position of this segment on each transcript. TABLE-US-00591 TABLE 26 Segment location on transcripts Segment Segment Transcript name starting position ending position HUMCA1XIA_T20 (SEQ ID NO:301) 1099 1271

Segment cluster HUMCA1XIA_node.sub.--18 (SEQ ID NO:308) according to the present invention is supported by 6 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 27 below describes the starting and ending position of this segment on each transcript. TABLE-US-00592 TABLE 27 Segment location on transcripts Segment Segment Transcript name starting position ending position HUMCA1XIA_T16 (SEQ ID NO:298) 1309 1522 HUMCA1XIA_T17 (SEQ ID NO:299) 1309 1522 HUMCA1XIA_T19 (SEQ ID NO:300) 1309 1522

Segment cluster HUMCA1XIA_node.sub.--54 (SEQ ID NO:309) according to the present invention is supported by 2 libraries. The number of libraries was determined as previously described. This segment can be found in the following transcript(s): HUMCA1XIA_T19 (SEQ ID NO:300). Table 28 below describes the starting and ending position of this segment on each transcript. TABLE-US-00593 TABLE 28 Segment location on transcripts Segment Segment Transcript name starting position ending position HUMCA1XIA_T19 (SEQ ID NO:300) 2407 2836

Segment cluster HUMCA1XIA_node.sub.--55 (SEQ ID NO:310) according to the present invention is supported by 4 libraries. The number of libraries was determined as previously described. This segment can be found in the following transcript(s): HUMCA1XIA_T17 (SEQ ID NO:299) and HUMCA1XIA_T19 (SEQ ID NO:300). Table 29 below describes the starting and ending position of this segment on each transcript. TABLE-US-00594 TABLE 29 Segment location on transcripts Segment Segment Transcript name starting position ending position HUMCA1XIA_T17 (SEQ ID NO 299) 2461 2648 HUMCA1XIA_T19 (SEQ ID NO 300) 2837 3475

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to breast cancer), shown in Table 30. TABLE-US-00595 TABLE 30 Oligonucleotides related to this segment Overexpressed Chip Oligonucleotide name in cancers reference HUMCA1XIA_0_0_14909 breast malignant BRS (SEQ ID NO:903) tumors Segment cluster HUMCA1XIA_node.sub.--92 (SEQ ID NO:311) according to the present invention is supported by 2 libraries. The number of libraries was determined as previously described. This segment can be found in the following transcript(s): HUMCA1XIA_T16 (SEQ ID NO:298). Table 31 below describes the starting and ending position of this segment on each transcript. TABLE-US-00596 TABLE 31

Segment location on transcripts Segment Segment Transcript name starting position ending position HUMCA1XIA_T16 (SEQ ID NO:298) 3487 3615

According to an optional embodiment of the present invention, short segments related to the above cluster are also provided. These segments are up to about 120 bp in length, and so are included in a separate description.

Segment cluster HUMCA1XIA_node.sub.--11 (SEQ ID NO:312) according to the present invention is supported by 3 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 32 below describes the starting and ending position of this segment on each transcript. TABLE-US-00597 TABLE 32 Segment location on transcripts Segment Segment Transcript name starting position ending position HUMCA1XIA_T16 (SEQ ID NO:298) 1099 1215 HUMCA1XIA_T17 (SEQ ID NO:299) 1099 1215 HUMCA1XIA_T19 (SEQ ID NO:300) 1099 1215

Segment cluster HUMCA1XIA_node.sub.--15 (SEQ ID NO:313) according to the present invention is supported by 5 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 33 below describes the starting and ending position of this segment on each transcript. TABLE-US-00598 TABLE 33 Segment location on transcripts Segment Segment Transcript name starting position ending position HUMCA1XIA_T16 (SEQ ID NO:298) 1216 1308 HUMCA1XIA_T17 (SEQ ID NO:299) 1216 1308 HUMCA1XIA_T19 (SEQ ID NO:300) 1216 1308

Segment cluster HUMCA1XIA_node.sub.--19 (SEQ ID NO:314) according to the present invention is supported by 3 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 34 below describes the starting and ending position of this segment on each transcript. TABLE-US-00599 TABLE 34 Segment location on transcripts Segment Segment Transcript name starting position ending position HUMCA1XIA_T16 (SEQ ID NO:298) 1523 1563 HUMCA1XIA_T17 (SEQ ID NO:299) 1523 1563 HUMCA1XIA_T19 (SEQ ID NO:300) 1523 1563

Segment cluster HUMCA1XIA_node.sub.--21 (SEQ ID NO:315) according to the present invention is supported by 2 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 35 below describes the starting and ending position of this segment on each transcript. TABLE-US-00600 TABLE 35 Segment location on transcripts Segment Segment Transcript name starting position ending position HUMCA1XIA_T16 (SEQ ID NO:298) 1564 1626 HUMCA1XIA_T17 (SEQ ID NO:299) 1564 1626 HUMCA1XIA_T19 (SEQ ID NO:300) 1564 1626

Segment cluster HUMCA1XIA_node.sub.--23 (SEQ ID NO:316) according to the present invention is supported by 3 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 36 below describes the starting and ending position of this segment on each transcript. TABLE-US-00601 TABLE 36 Segment location on transcripts Segment Segment Transcript name starting position ending position HUMCA1XIA_T16 (SEQ ID NO:298) 1627 1668 HUMCA1XIA_T17 (SEQ ID NO:299) 1627 1668 HUMCA1XIA_T19 (SEQ ID NO:300) 1627 1668

Segment cluster HUMCA1XIA_node.sub.--25 (SEQ ID NO:317) according to the present invention is supported by 3 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 37 below describes the starting and ending position of this segment on each transcript. TABLE-US-00602 TABLE 37 Segment location on transcripts Segment Segment Transcript name starting position ending position HUMCA1XIA_T16 (SEQ ID NO:298) 1669 1731 HUMCA1XIA_T17 (SEQ ID NO:299) 1669 1731 HUMCA1XIA_T19 (SEQ ID NO:300) 1669 1731

Segment cluster HUMCA1XIA_node.sub.--27 (SEQ ID NO:318) according to the present invention is supported by 2 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 38 below describes the starting and ending position of this segment on each transcript. TABLE-US-00603 TABLE 38 Segment location on transcripts Segment Segment Transcript name starting position ending position HUMCA1XIA_T16 (SEQ ID NO:298) 1732 1806 HUMCA1XIA_T17 (SEQ ID NO:299) 1732 1806 HUMCA1XIA_T19 (SEQ ID NO:300) 1732 1806

Segment cluster HUMCA1XIA_node.sub.--29 (SEQ ID NO:319) according to the present invention is supported by 3 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 39 below describes the starting and ending position of this segment on each transcript. TABLE-US-00604 TABLE 39 Segment location on transcripts Segment Segment Transcript name starting position ending position HUMCA1XIA_T16 (SEQ ID NO:298) 1807 1890 HUMCA1XIA_T17 (SEQ ID NO:299) 1807 1890 HUMCA1XIA_T19 (SEQ ID NO:300) 1807 1890

Segment cluster HUMCA1XIA_node.sub.--31 (SEQ ID NO:320) according to the present invention is supported by 3 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 40 below describes the starting and ending position of this segment on each transcript. TABLE-US-00605 TABLE 40 Segment location on transcripts Segment Segment Transcript name starting position ending position HUMCA1XIA_T16 (SEQ ID NO:298) 1891 1947 HUMCA1XIA_T17 (SEQ ID NO:299) 1891 1947 HUMCA1XIA_T19 (SEQ ID NO:300) 1891 1947

Segment cluster HUMCA1XIA_node.sub.--33 (SEQ ID NO:321) according to the present invention is supported by 3 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 41 below describes the starting and ending position of this segment on each transcript. TABLE-US-00606 TABLE 41 Segment location on transcripts Segment Segment Transcript name starting position ending position HUMCA1XIA_T16 (SEQ ID NO:298) 1948 2001 HUMCA1XIA_T17 (SEQ ID NO:299) 1948 2001 HUMCA1XIA_T19 (SEQ ID NO:300) 1948 2001

Segment cluster HUMCA1XIA_node.sub.--35 (SEQ ID NO:322) according to the present invention is supported by 4 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 42 below describes the starting and ending position of this segment on each transcript. TABLE-US-00607 TABLE 42 Segment location on transcripts Segment Segment Transcript name starting position ending position HUMCA1XIA_T16 (SEQ ID NO:298) 2002 2055 HUMCA1XIA_T17 (SEQ ID NO:299) 2002 2055 HUMCA1XIA_T19 (SEQ ID NO:300) 2002 2055

Segment cluster HUMCA1XIA_node.sub.--37 (SEQ ID NO:323) according to the present invention is supported by 4 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 43 below describes the starting and ending position of this segment on each transcript. TABLE-US-00608 TABLE 43 Segment location on transcripts Segment Segment Transcript name starting position ending position HUMCA1XIA_T16 (SEQ ID NO:298) 2056 2109 HUMCA1XIA_T17 (SEQ ID NO:299) 2056 2109 HUMCA1XIA_T19 (SEQ ID NO:300) 2056 2109

Segment cluster HUMCA1XIA_node.sub.--39 (SEQ ID NO:324) according to the present invention is supported by 5 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 44 below describes the starting and ending position of this segment on each transcript. TABLE-US-00609 TABLE 44 Segment location on transcripts Segment Segment Transcript name starting position ending position HUMCA1XIA_T16 (SEQ ID NO:298) 2110 2163 HUMCA1XIA_T17 (SEQ ID NO:299) 2110 2163 HUMCA1XIA_T19 (SEQ ID NO:300) 2110 2163

Segment cluster HUMCA1XIA_node.sub.--41 (SEQ ID NO:325) according to the present invention is supported by 4 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 45 below describes the starting and ending position of this segment on each transcript. TABLE-US-00610 TABLE 45 Segment location on transcripts Segment Segment Transcript name starting position ending position HUMCA1XIA_T16 (SEQ ID NO:298) 2164 2217 HUMCA1XIA_T17 (SEQ ID NO:299) 2164 2217 HUMCA1XIA_T19 (SEQ ID NO:300) 2164 2217

Segment cluster HUMCA1XIA_node.sub.--43 (SEQ ID NO:326),according to the present invention is supported by 5 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 46 below describes the starting and ending position of this segment on each transcript. TABLE-US-00611 TABLE 46 Segment location on transcripts Segment Segment Transcript name starting position ending position HUMCA1XIA_T16 (SEQ ID NO:298) 2218 2262 HUMCA1XIA_T17 (SEQ ID NO:299) 2218 2262 HUMCA1XIA_T19 (SEQ ID NO:300) 2218 2262

Segment cluster HUMCA1XIA_node.sub.--45 (SEQ ID NO:327) according to the present invention is supported by 4 libraries. The number of libraries was determined as previously described. This segment can be found in the following transcript(s): HUMCA1XIA_T16 (SEQ ID NO:298) and HUMCA1XIA_T17 (SEQ ID NO:299). Table 47 below describes the starting and ending position of this segment on each transcript. TABLE-US-00612 TABLE 47 Segment location on transcripts Segment Segment Transcript name starting position ending position HUMCA1XIA_T16 (SEQ ID NO:298) 2263 2316 HUMCA1XIA_T17 (SEQ ID NO:299) 2263 2316

Segment cluster HUMCA1XIA_node.sub.--47 (SEQ ID NO:328) according to the present invention is supported by 5 libraries. The number of libraries was determined as previously described. This segment can be found in the following transcript(s): HUMCA1XIA_T16 (SEQ ID NO:298, HUMCA1XIA_T17 (SEQ ID NO:299) and HUMCA1XIA_T19 (SEQ ID NO:300). Table 48 below describes the starting and ending position of this segment on each transcript. TABLE-US-00613 TABLE 48 Segment location on transcripts Segment Segment Transcript name starting position ending position HUMCA1XIA_T16 (SEQ ID NO:298) 2317 2361 HUMCA1XIA_T17 (SEQ ID NO:299) 2317 2361 HUMCA1XIA_T19 (SEQ ID NO:300) 2263 2307

Segment cluster HUMCA1XIA_node.sub.--49 (SEQ ID NO:329) according to the present invention is supported by 5 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 49 below describes the starting and ending position of this segment on each transcript. TABLE-US-00614 TABLE 49 Segment location on transcripts Segment Segment Transcript name starting position ending position HUMCA1XIA_T16 (SEQ ID NO:298) 2362 2415 HUMCA1XIA_T17 (SEQ ID NO:299) 2362 2415 HUMCA1XIA_T19 (SEQ ID NO:300) 2308 2361

Segment cluster HUMCA1XIA_node.sub.--51 (SEQ ID NO:330) according to the present invention is supported by 7 libraries. The number of libraries was determined as previously described. This segment can be found in the following transcript(s): HUMCA1XIA_T16 (SEQ ID NO:298), HUMCA1XIA_T17 (SEQ ID NO:299) and HUMCA1XIA_T19 (SEQ ID NO:300). Table 50 below describes the starting and ending position of this segment on each transcript. TABLE-US-00615 TABLE 50 Segment location on transcripts Segment Segment Transcript name starting position ending position HUMCA1XIA_T16 (SEQ ID NO:298) 2416 2460 HUMCA1XIA_T17 (SEQ ID NO:299) 2416 2460 HUMCA1XIA_T19 (SEQ ID NO:300) 2362 2406

Segment cluster HUMCA1XIA_node.sub.--57 (SEQ ID NO:331) according to the present invention is supported by 4 libraries. The number of libraries was determined as previously described. This segment can be found in the following transcript(s): HUMCA1XIA_T16 (SEQ ID NO:298). Table 51 below describes the starting and ending position of this segment on each transcript. TABLE-US-00616 TABLE 51 Segment location on transcripts Segment Segment Transcript name starting position ending position HUMCA1XIA_T16 (SEQ ID NO:298) 2461 2514

Segment cluster HUMCA1XIA_node.sub.--59 (SEQ ID NO:332) according to the present invention is supported by 3 libraries. The number of libraries was determined as previously described. This segment can be found in the following transcript(s): HUMCA1XIA_T16 (SEQ ID NO:298). Table 52 below describes the starting and ending position of this segment on each transcript. TABLE-US-00617 TABLE 52 Segment location on transcripts Segment Segment Transcript name starting position ending position HUMCA1XIA_T16 (SEQ ID NO:298) 2515 2559

Segment cluster HUMCA1XIA_node.sub.--62 (SEQ ID NO:333) according to the present invention is supported by 3 libraries. The number of libraries was determined as previously described. This segment can be found in the following transcript(s): HUMCA1XIA_T16 (SEQ ID NO:298). Table 53 below describes the starting and ending position of this segment on each transcript. TABLE-US-00618 TABLE 53 Segment location on transcripts Segment Segment Transcript name starting position ending position HUMCA1XIA_T16 (SEQ ID NO:298) 2560 2613

Segment cluster HUMCA1XIA_node.sub.--64 (SEQ ID NO:334) according to the present invention is supported by 4 libraries. The number of libraries was determined as previously described. This segment can be found in the following transcript(s): HUMCA1XIA_T16 (SEQ ID NO:298). Table 54 below describes the starting and ending position of this segment on each transcript. TABLE-US-00619 TABLE 54 Segment location on transcripts Segment Segment Transcript name starting position ending position HUMCA1XIA_T16 (SEQ ID NO:298) 2614 2658

Segment cluster HUMCA1XIA_node.sub.--66 (SEQ ID NO:335) according to the present invention is supported by 4 libraries. The number of libraries was determined as previously described. This segment can be found in the following transcript(s): HUMCA1XIA_T16 (SEQ ID NO:298). Table 55 below describes the starting and ending position of this segment on each transcript. TABLE-US-00620 TABLE 55 Segment location on transcripts Segment Segment Transcript name starting position ending position HUMCA1XIA_T16 (SEQ ID NO:298) 2659 2712

Segment cluster HUMCA1XIA_node.sub.--68 (SEQ ID NO:336) according to the present invention is supported by 7 libraries. The number of libraries was determined as previously described. This segment can be found in the following transcript(s): HUMCA1XIA_T16 (SEQ ID NO:298). Table 56 below describes the starting and ending position of this segment on each transcript. TABLE-US-00621 TABLE 56 Segment location on transcripts Segment Segment starting ending Transcript name position position HUMCA1XIA_T16 (SEQ ID NO:298) 2713 2820

Segment cluster HUMCA1XIA_node.sub.--70 (SEQ ID NO:337) according to the present invention is supported by 6 libraries. The number of libraries was determined as previously described. This segment can be found in the following transcript(s): HUMCA1XIA_T16 (SEQ ID NO:298). Table 57 below describes the starting and ending position of this segment on each transcript. TABLE-US-00622 TABLE 57 Segment location on transcripts Segment Segment starting ending Transcript name position position HUMCA1XIA_T16 (SEQ ID NO:298) 2821 2874

Segment cluster HUMCA1XIA_node.sub.--72 (SEQ ID NO:338) according to the present invention is supported by 6 libraries. The number of libraries was determined as previously described. This segment can be found in the following transcript(s): HUMCA1XIA_T16 (SEQ ID NO:298). Table 58 below describes the starting and ending position of this segment on each transcript. TABLE-US-00623 TABLE 58 Segment location on transcripts Segment Segment starting ending Transcript name position position HUMCA1XIA_T16 (SEQ ID NO:298) 2875 2928

Segment cluster HUMCA1XIA_node.sub.--74 (SEQ ID NO:339) according to the present invention is supported by 5 libraries. The number of libraries was determined as previously described. This segment can be found in the following transcript(s): HUMCA1XIA_T16 (SEQ ID NO:298). Table 59 below describes the starting and ending position of this segment on each transcript. TABLE-US-00624 TABLE 59 Segment location on transcripts Segment Segment starting ending Transcript name position position HUMCA1XIA_T16 (SEQ ID NO:298) 2929 2973

Segment cluster HUMCA1XIA_node.sub.--76 (SEQ ID NO:340) according to the present invention is supported by 6 libraries. The number of libraries was determined as previously described. This segment can be found in the following transcript(s): HUMCA1XIA_T16 (SEQ ID NO:298). Table 60 below describes the starting and ending position of this segment on each transcript. TABLE-US-00625 TABLE 60 Segment location on transcripts Segment Segment starting ending Transcript name position position HUMCA1XIA_T16 (SEQ ID NO:298) 2974 3027

Segment cluster HUMCA1XIA_node.sub.--78 (SEQ ID NO:341) according to the present invention is supported by 6 libraries. The number of libraries was determined as previously described. This segment can be found in the following transcript(s): HUMCA1XIA_T16 (SEQ ID NO:298). Table 61 below describes the starting and ending position of this segment on each transcript. TABLE-US-00626 TABLE 61 Segment location on transcripts Segment Segment starting ending Transcript name position position HUMCA1XIA_T16 (SEQ ID NO:298) 3028 3072

Segment cluster HUMCA1XIA_node.sub.--81 (SEQ ID NO:342) according to the present invention is supported by 8 libraries. The number of libraries was determined as previously described. This segment can be found in the following transcript(s): HUMCA1XIA_T16 (SEQ ID NO:298). Table 62 below describes the starting and ending position of this segment on each transcript. TABLE-US-00627 TABLE 62 Segment location on transcripts Segment Segment starting ending Transcript name position position HUMCA1XIA_T16 (SEQ ID NO:298) 3073 3126

Segment cluster HUMCA1XIA_node.sub.--83 (SEQ ID NO:343) according to the present invention is supported by 7 libraries. The number of libraries was determined as previously described. This segment can be found in the following transcript(s): HUMCA1XIA_T16 (SEQ ID NO:298). Table 63 below describes the starting and ending position of this segment on each transcript. TABLE-US-00628 TABLE 63 Segment location on transcripts Segment Segment starting ending Transcript name position position HUMCA1XIA_T16 (SEQ ID NO:298) 3127 3180

Segment cluster HUMCA1XIA_node.sub.--85 (SEQ ID NO:344) according to the present invention is supported by 6 libraries. The number of libraries was determined as previously described. This segment can be found in the following transcript(s): HUMCA1XIA_T16 (SEQ ID NO:298). Table 64 below describes the starting and ending position of this segment on each transcript. TABLE-US-00629 TABLE 64 Segment location on transcripts Segment Segment starting ending Transcript name position position HUMCA1XIA_T16 (SEQ ID NO:298) 3181 3234

Segment cluster HUMCA1XIA_node.sub.--87 (SEQ ID NO:345) according to the present invention is supported by 10 libraries. The number of libraries was determined as previously described. This segment can be found in the following transcript(s): HUMCA1XIA_T16 (SEQ ID NO:298). Table 65 below describes the starting and ending position of this segment on each transcript. TABLE-US-00630 TABLE 65

Segment location on transcripts Segment Segment starting ending Transcript name position position HUMCA1XIA_T16 (SEQ ID NO:298) 3235 3342

Segment cluster HUMCA1XIA_node.sub.--89 (SEQ ID NO:346) according to the present invention is supported by 9 libraries. The number of libraries was determined as previously described. This segment can be found in the following transcript(s): HUMCA1XIA_T16 (SEQ ID NO:298). Table 66 below describes the starting and ending position of this segment on each transcript. TABLE-US-00631 TABLE 66 Segment location on transcripts Segment Segment starting ending Transcript name position position HUMCA1XIA_T16 (SEQ ID NO:298) 3343 3432

Segment cluster HUMCA1XIA_node.sub.--91 (SEQ ID NO:347) according to the present invention is supported by 11 libraries. The number of libraries was determined as previously described. This segment can be found in the following transcript(s): HUMCA1XIA_T16 (SEQ ID NO:298). Table 67 below describes the starting and ending position of this segment on each transcript. TABLE-US-00632 TABLE 67 Segment location on transcripts Segment Segment starting ending Transcript name position position HUMCA1XIA_T16 (SEQ ID NO:298) 3433 3486

Transcript Nucleic Acid Sequences:
Variant protein alignment to the previously known protein:
Sequence name: CA1B_HUMAN_V5 (SEQ ID NO:349)
Sequence Documentation:
Alignment of: HUMCA1XIA_P14 (SEQ ID NO:350).times.CA1B_HUMAN_V5 (SEQ ID NO:349).

Alignment segment 1/1: TABLE-US-00633 Quality: 10456.00 Escore: 0 Matching length: 1058 Total length: 1058 Matching Percent 99.91 Matching Percent 99.91 Similarity: Identity: Total Percent Similarity: 99.91 Total Percent Identity: 99.91 Gaps: 0

```
Alignment: TABLE-US-00634 . . . 1
MEPWSSRWKTKRWLWDFTVTTLALTFLFQAREVRGAAPVDVLKALDFHNS    50
||||||||||||||||||||||||||||||||||||||||||||||||||     1
MEPWSSRWKTKRWLWDFTVTTLALTFLFQAREVRGAAPVDVLKALDFHNS    50 . . . 51

PEGISKTTGFCTNRKNSKGSDTAYRVSKQAQLSAPTKQLFPGGTFPEDFS   100
||||||||||||||||||||||||||||||||||||||||||||||||||    51
PEGISKTTGFCTNRKNSKGSDTAYRVSKQAQLSAPTKQLFPGGTFPEDFS   100 . . . 101

ILFTVKPKKGIQSFLLSIYNEHGIQQIGVEVGRSPVFLFEDHTGKPAPED   150
||||||||||||||||||||||||||||||||||||||||||||||||||   101
ILFTVKPKKGIQSFLLSIYNEHGIQQIGVEVGRSPVFLFEDHTGKPAPED   150 . . . 151

YPLFRTVNIADGKWHRVAISVEKKTVTMIVDCKKKTTKPLDRSERAIVDT   200
||||||||||||||||||||||||||||||||||||||||||||||||||   151
YPLFRTVNIADGKWHRVAISVEKKTVTMIVDCKKKTTKPLDRSERAIVDT   200 . . . 201

NGITVFGTRILDEEVFEGDIQQFLITGDPKAAYDYCEHYSPDCDSSAPKA   250
||||||||||||||||||||||||||||||||||||||||||||||||||   201
NGITVFGTRILDEEVFEGDIQQFLITGDPKAAYDYCEHYSPDCDSSAPKA   250 . . . 251

AQAQEPQIDEYAPEDIIEYDYEYGEAEYKEAESVTEGPTVTEETIAQTEA   300
||||||||||||||||||||||||||||||||||||||||||||||||||   251
AQAQEPQIDEYAPEDIIEYDYEYGEAEYKEAESVTEGPTVTEETIAQTEA   300 . . . 301

NIVDDFQEYNYGTMESYQTEAPRHVSGTNEPNPVEEIFTEEYLTGEDYDS   350
||||||||||||||||||||||||||||||||||||||||||||||||||   301
NIVDDFQEYNYGTMESYQTEAPRHVSGTNEPNPVEEIFTEEYLTGEDYDS   350 . . . 351

QRKNSEDTLYENKEIDGRDSDLLVDGDLGEYDFYEYKEYEDKPTSPPNEE   400
||||||||||||||||||||||||||||||||||||||||||||||||||   351
QRKNSEDTLYENKEIDGRDSDLLVDGDLGEYDFYEYKEYEDKPTSPPNEE   400 . . . 401

FGPGVPAETDITETSINGHGAYGEKGQKGEPAVVEPGMLVEGPPGPAGPA   450
||||||||||||||||||||||||||||||||||||||||||||||||||   401
FGPGVPAETDITETSINGHGAYGEKGQKGEPAVVEPGMLVEGPPGPAGPA   450 . . . 451

GIMGPPGLQGPTGPPGDPGDRGPPGRPGLPGADGLPGPPGTMLMLPFRYG   500
||||||||||||||||||||||||||||||||||||||||||||||||||   451
GIMGPPGLQGPTGPPGDPGDRGPPGRPGLPGADGLPGPPGTMLMLPFRYG   500 . . . 501

GDGSKGPTISAQEAQAQAILQQARIALRGPPGPMGLTGRPGPVGGPGSSG   550
||||||||||||||||||||||||||||||||||||||||||||||||||   501
GDGSKGPTISAQEAQAQAILQQARIALRGPPGPMGLTGRPGPVGGPGSSG   550 . . . 551

AKGESGDPGPQGPRGVQGPPGPTGKPGKRGRPGADGGRGMPGEPGAKGDR   600
||||||||||||||||||||||||||||||||||||||||||||||||||   551
AKGESGDPGPQGPRGVQGPPGPTGKPGKRGRPGADGGRGMPGEPGAKGDR   600 . . . 601

GFDGLPGLPGDKGHRGERGPQGPPGPPGDDGMRGEDGEIGPRGLPGEAGP   650
||||||||||||||||||||||||||||||||||||||||||||||||||   601
GFDGLPGLPGDKGHRGERGPQGPPGPPGDDGMRGEDGEIGPRGLPGEAGP   650 . . . 651

RGLLGPRGTPGAPGQPGMAGVDGPPGPKGNMGPQGEPGPPGQQGNPGPQG   700
||||||||||||||||||||||||||||||||||||||||||||||||||   651
RGLLGPRGTPGAPGQPGMAGVDGPPGPKGNMGPQGEPGPPGQQGNPGPQG   700 . . . 701

LPGPQGPIGPPGEKGPQGKPGLAGLPGADGPPGHPGKEGQSGEKGALGPP   750
```

-continued

```
|||||||||||||||||||||||||||||||||||||||||||||||||      701
LPGPQGPIGPPGEKGPQGKPGLAGLPGADGPPGHPGKEGQSGEKGALGPP    750 . . . 751

GPQGPIGYPGPRGVKGADGVRGLKGSKGEKGEDGFPGFKGDMGLKGDRGE    800
|||||||||||||||||||||||||||||||||||||||||||||||||      751
GPQGPIGYPGPRGVKGADGVRGLKGSKGEKGEDGFPGFKGDMGLKGDRGE    800 . . . 801

VGQIGPRGEDGPEGPKGRAGPTGDPGPSGQAGEKGKLGVPGLPGYPGRQG    850
|||||||||||||||||||||||||||||||||||||||||||||||||      801
VGQIGPRGEDGPEGPKGRAGPTGDPGPSGQAGEKGKLGVPGLPGYPGRQG    850 . . . 851

PKGSTGFPGFPGANGEKGARGVAGKPGPRGQRGPTGPRGSRGARGPTGKP    900
|||||||||||||||||||||||||||||||||||||||||||||||||      851
PKGSTGFPGFPGANGEKGARGVAGKPGPRGQRGPTGPRGSRGARGPTGKP    900 . . . 901

GPKGTSGGDGPPGPPGERGPQGPQGPVGFPGPKGPPGPPGKDGLPGHPGQ    950
|||||||||||||||||||||||||||||||||||||||||||||||||      901
GPKGTSGGDGPPGPPGERGPQGPQGPVGFPGPKGPPGPPGKDGLPGHPGQ    950 . . . 951

RGETGFQGKTGPPGPGGVVGPQGPTGETGPIGERGHPGPPGPPGEQGLPG   1000
|||||||||||||||||||||||||||||||||||||||||||||||||      951
RGETGFQGKTGPPGPGGVVGPQGPTGETGPIGERGHPGPPGPPGEQGLPG   1000 . . . 1001

AAGKEGAKGDPGPQGISGKDGPAGLRGFPGERGLPGAQGAPGLKGGEGPQ   1050
|||||||||||||||||||||||||||||||||||||||||||||||||     1001
AAGKEGAKGDPGPQGISGKDGPAGLRGFPGERGLPGAQGAPGLKGGEGPQ   1050 . . . 1051

GPPGPVGS                                             1058
||||||||                                             1051
GPPGPVGS                                             1058
```

Sequence name: CA1B_HUMAN (SEQ ID NO:348)
Sequence Documentation:
Alignment of: HUMCA1XIA_P15 (SEQ ID NO:351).times.CA1B_HUMAN (SEQ ID NO:348).

Alignment segment 1/1: TABLE-US-00635 Quality: 7073.00 Escore: 0 Matching length: 714 Total length: 714 Matching Percent 100.00 Matching Percent 100.00 Similarity: Identity: Total Percent Similarity: 100.00 Total Percent Identity: 100.00 Gaps: 0

```
Alignment: TABLE-US-00636 . . . 1
MEPWSSRWKTKRWLWDFTVTTLALTFLFQAREVRGAAPVDVLKALDFHNS    50
|||||||||||||||||||||||||||||||||||||||||||||||||     1
MEPWSSRWKTKRWLWDFTVTTLALTFLFQAREVRGAAPVDVLKALDFHNS    50 . . . 51

PEGISKTTGFCTNRKNSKGSDTAYRVSKQAQLSAPTKQLFPGGTFPEDFS   100
|||||||||||||||||||||||||||||||||||||||||||||||||    51
PEGISKTTGFCTNRKNSKGSDTAYRVSKQAQLSAPTKQLFPGGTFPEDFS   100 . . . 101

ILFTVKPKKGIQSFLLSIYNEHGIQQIGVEVGRSPVFLFEDHTGKPAPED   150
|||||||||||||||||||||||||||||||||||||||||||||||||    101
ILFTVKPKKGIQSFLLSIYNEHGIQQIGVEVGRSPVFLFEDHTGKPAPED   150 . . . 151

YPLFRTVNIADGKWHRVAISVEKKTVTMIVDCKKKTTKPLDRSERAIVDT   200
|||||||||||||||||||||||||||||||||||||||||||||||||    151
YPLFRTVNIADGKWHRVAISVEKKTVTMIVDCKKKTTKPLDRSERAIVDT   200 . . . 201

NGITVFGTRILDEEVFEGDIQQFLITGDPKAAYDYCEHYSPDCDSSAPKA   250
|||||||||||||||||||||||||||||||||||||||||||||||||    201
NGITVFGTRILDEEVFEGDIQQFLITGDPKAAYDYCEHYSPDCDSSAPKA   250 . . . 251

AQAQEPQIDEYAPEDIIEYDYEYGEAEYKEAESVTEGPTVTEETIAQTEA   300
|||||||||||||||||||||||||||||||||||||||||||||||||    251
AQAQEPQIDEYAPEDIIEYDYEYGEAEYKEAESVTEGPTVTEETIAQTEA   300 . . . 301

NIVDDFQEYNYGTMESYQTEAPRHVSGTNEPNPVEEIFTEEYLTGEDYDS   350
|||||||||||||||||||||||||||||||||||||||||||||||||    301
NIVDDFQEYNYGTMESYQTEAPRHVSGTNEPNPVEEIFTEEYLTGEDYDS   350 . . . 351

QRKNSEDTLYENKEIDGRDSDLLVDGDLGEYDFYEYKEYEDKPTSPPNEE   400
|||||||||||||||||||||||||||||||||||||||||||||||||    351
QRKNSEDTLYENKEIDGRDSDLLVDGDLGEYDFYEYKEYEDKPTSPPNEE   400 . . . 401

FGPGVPAETDITETSINGHGAYGEKGQKGEPAVVEPGMLVEGPPGPAGPA   450
|||||||||||||||||||||||||||||||||||||||||||||||||    401
FGPGVPAETDITETSINGHGAYGEKGQKGEPAVVEPGMLVEGPPGPAGPA   450 . . . 451
```

-continued

```
GIMGPPGLQGPTGPPGDPGDRGPPGRPGLPGADGLPGPPGTMLMLPFRYG    500
||||||||||||||||||||||||||||||||||||||||||||||||||   451
GIMGPPGLQGPTGPPGDPGDRGPPGRPGLPGADGLPGPPGTMLMLPFRYG    500 . . . 501

GDGSKGPTISAQEAQAQAILQQARIALRGPPGPMGLTGRPGPVGGPGSSG    550
||||||||||||||||||||||||||||||||||||||||||||||||||   501
GDGSKGPTISAQEAQAQAILQQARIALRGPPGPMGLTGRPGPVGGPGSSG    550 . . . 551

AKGESGDPGPQGPRGVQGPPGPTGKPGKRGRPGADGGRGMPGEPGAKGDR    600
|||||||||||||||||||||||||||||||||||||||||||||||||    551
AKGESGDPGPQGPRGVQGPPGPTGKPGKRGRPGADGGRGMPGEPGAKGDR    600 . . . 601

GFDGLPGLPGDKGHRGERGPQGPPGPPGDDGMRGEDGEIGPRGLPGEAGP    650
|||||||||||||||||||||||||||||||||||||||||||||||||    601
GFDGLPGLPGDKGHRGERGPQGPPGPPGDDGMRGEDGEIGPRGLPGEAGP    650 . . . 651

RGLLGPRGTPGAPGQPGMAGVDGPPGPKGNMGPQGEPGPPGQQGNPGPQG    700
|||||||||||||||||||||||||||||||||||||||||||||||||    651
RGLLGPRGTPGAPGQPGMAGVDGPPGPKGNMGPQGEPGPPGQQGNPGPQG    700 . . . 701

LPGPQGPIGPPGEK                                       714
||||||||||||||                                       701
LPGPQGPIGPPGEK                                       714
```

Sequence name: CA1B_HUMAN (SEQ ID NO:348)

Sequence Documentation:

Alignment of: HUMCA1XIA_P16 (SEQ ID NO:352).times.CA1B_HUMAN (SEQ ID NO:348).

Alignment segment 1/1: TABLE-US-00637 Quality: 6795.00 Escore: 0 Matching length: 696 Total length: 714 Matching Percent 100.00 Matching Percent Identity: 100.00 Similarity: Total Percent Similarity: 97.48 Total Percent Identity: 97.48 Gaps: 1

```
Alignment: TABLE-US-00638 . . . 1
MEPWSSRWKTKRWLWDFTVTTLALTFLFQAREVRGAAPVDVLKALDFHNS    50
|||||||||||||||||||||||||||||||||||||||||||||||||    1
MEPWSSRWKTKRWLWDFTVTTLALTFLFQAREVRGAAPVDVLKALDFHNS    50 . . . 51

PEGISKTTGFCTNRKNSKGSDTAYRVSKQAQLSAPTKQLFPGGTFPEDFS    100
|||||||||||||||||||||||||||||||||||||||||||||||||    51
PEGISKTTGFCTNRKNSKGSDTAYRVSKQAQLSAPTKQLFPGGTFPEDFS    100 . . . 101

ILFTVKPKKGIQSFLLSIYNEHGIQQIGVEVGRSPVFLFEDHTGKPAPED    150
|||||||||||||||||||||||||||||||||||||||||||||||||    101
ILFTVKPKKGIQSFLLSIYNEHGIQQIGVEVGRSPVFLFEDHTGKPAPED    150 . . . 151

YPLFRTVNIADGKWHRVAISVEKKTVTMIVDCKKKTTKPLDRSERAIVDT    200
|||||||||||||||||||||||||||||||||||||||||||||||||    151
YPLFRTVNIADGKWHRVAISVEKKTVTMIVDCKKKTTKPLDRSERAIVDT    200 . . . 201

NGITVFGTRILDEEVFEGDIQQFLITGDPKAAYDYCEHYSPDCDSSAPKA    250
|||||||||||||||||||||||||||||||||||||||||||||||||    201
NGITVFGTRILDEEVFEGDIQQFLITGDPKAAYDYCEHYSPDCDSSAPKA    250 . . . 251

AQAQEPQIDEYAPEDIIEYDYEYGEAEYKEAESVTEGPTVTEETIAQTEA    300
|||||||||||||||||||||||||||||||||||||||||||||||||    251
AQAQEPQIDEYAPEDIIEYDYEYGEAEYKEAESVTEGPTVTEETIAQTEA    300 . . . 301

NIVDDFQEYNYGTMESYQTEAPRHVSGTNEPNPVEEIFTEEYLTGEDYDS    350
|||||||||||||||||||||||||||||||||||||||||||||||||    301
NIVDDFQEYNYGTMESYQTEAPRHVSGTNEPNPVEEIFTEEYLTGEDYDS    350 . . . 351

QRKNSEDTLYENKEIDGRDSDLLVDGDLGEYDFYEYKEYEDKPTSPPNEE    400
|||||||||||||||||||||||||||||||||||||||||||||||||    351
QRKNSEDTLYENKEIDGRDSDLLVDGDLGEYDFYEYKEYEDKPTSPPNEE    400 . . . 401

FGPGVPAETDITETSINGHGAYGEKGQKGEPAVVEPGMLVEGPPGPAGPA    450
|||||||||||||||||||||||||||||||||||||||||||||||||    401
FGPGVPAETDITETSINGHGAYGEKGQKGEPAVVEPGMLVEGPPGPAGPA    450 . . . 451

GIMGPPGLQGPTGPPGDPGDRGPPGRPGLPGADGLPGPPGTMLMLPFRYG    500
|||||||||||||||||||||||||||||||||||||||||||||||||    451
GIMGPPGLQGPTGPPGDPGDRGPPGRPGLPGADGLPGPPGTMLMLPFRYG    500 . . . 501

GDGSKGPTISAQEAQAQAILQQARIALRGPPGPMGLTGRPGPVGGPGSSG    550
|||||||||||||||||||||||||||||||||||||||||||||||||    501
GDGSKGPTISAQEAQAQAILQQARIALRGPPGPMGLTGRPGPVGGPGSSG    550 . . . 551
```

-continued

```
AKGESGDPGPQGPRGVQGPPGPTGKPGKRGRPGADGGRGMPGEPGAKGDR   600
||||||||||||||||||||||||||||||||||||||||||||||||||   551
AKGESGDPGPQGPRGVQGPPGPTGKPGKRGRPGADGGRGMPGEPGAKGDR   600 . . . 601

GFDGLPGLPGDKGHRGERGPQGPPGPPGDDGMRGEDGEIGPRGLPGEA..   648
|||||||||||||||||||||||||||||||||||||||||||||||     601
GFDGLPGLPGDKGHRGERGPQGPPGPPGDDGMRGEDGEIGPRGLPGEAGP   650 . . . 649

...............GMAGVDGPPGPKGNMGPQGEPGPPGQQGNPGPQG   682
               ||||||||||||||||||||||||||||||||||   651
RGLLGPRGTPGAPGQPGMAGVDGPPGPKGNMGPQGEPGPPGQQGNPGPQG   700 . . . 683

LPGPQGPIGPPGEK   696
||||||||||||||   701
LPGPQGPIGPPGEK   714
```

Sequence Documentation:
Alignment of: HUMCA1XIA_P17 (SEQ ID NO:353).times.CA1B HUMAN (SEQ ID NO:348).
Alignment segment 1/1: TABLE-US-00639 Quality: 2561.00 Escore: 0 Matching length: 260 Total length: 260 Matching Percent 100.00 Matching Percent Identity: 100.00 Similarity: Total Percent Similarity: 100.00 Total Percent Identity: 100.00 Gaps: 0

```
Alignment: TABLE-US-00640 . . . 1
MEPWSSRWKTKRWLWDFTVTTLALTFLFQAREVRGAAPVDVLKALDFHNS   50
||||||||||||||||||||||||||||||||||||||||||||||||||   1
MEPWSSRWKTKRWLWDFTVTTLALTFLFQAREVRGAAPVDVLKALDFHNS   50 . . . 51

PEGISKTTGFCTNRKNSKGSDTAYRVSKQAQLSAPTKQLFPGGTFPEDFS   100
||||||||||||||||||||||||||||||||||||||||||||||||||   51
PEGISKTTGFCTNRKNSKGSDTAYRVSKQAQLSAPTKQLFPGGTFPEDFS   100 . . . 101

ILFTVKPKKGIQSFLLSIYNEHGIQQIGVEVGRSPVFLFEDHTGKPAPED   150
||||||||||||||||||||||||||||||||||||||||||||||||||   101
ILFTVKPKKGIQSFLLSIYNEHGIQQIGVEVGRSPVFLFEDHTGKPAPED   150 . . . 151

YPLFRTVNIADGKWHRVAISVEKKTVTMIVDCKKKTTKPLDRSERAIVDT   200
||||||||||||||||||||||||||||||||||||||||||||||||||   151
YPLFRTVNIADGKWHRVAISVEKKTVTMIVDCKKKTTKPLDRSERAIVDT   200 . . . 201

NGITVFGTRILDEEVFEGDIQQFLITGDPKAAYDYCEHYSPDCDSSAPKA   250
||||||||||||||||||||||||||||||||||||||||||||||||||   201
NGITVFGTRILDEEVFEGDIQQFLITGDPKAAYDYCEHYSPDCDSSAPKA   250 . . . 251

AQAQEPQIDE   260
||||||||||   251
AQAQEPQIDE   260
```

Description for Cluster R20779

Cluster R20779 features 1 transcript(s) and 24 segment(s) of interest, the names for which are given in Tables 1 and 2, respectively, the sequences themselves are given at the end of the application. The selected protein variants are given in table 3. TABLE-US-00641 TABLE 1 Transcripts of interest Transcript Name Sequence ID No. R20779_T7 354

TABLE-US-00642 TABLE 2 Segments of interest Segment Name Sequence ID No. R20779_node_0 355 R20779_node_2 356 R20779_node_7 357 R20779_node_9 358 R20779_node_18 359 R20779_node_21 360 R20779_node_24 361 R20779_node_27 362 R20779_node_28 363 R20779_node_30 364 R20779_node_31 365 R20779_node_32 366 R20779_node_1 367 R20779_node_3 368 R20779_node_10 369 R20779_node_11 370 R20779_node_14 371 R20779_node_17 372 R20779_node_19 373 R20779_node_20 374 R20779_node_22 375 R20779_node_23 376 R20779_node_25 377 R20779_node_29 378

TABLE-US-00643 TABLE 3 Proteins of interest Protein Name Sequence ID No. Corresponding Transcript(s) R20779_P2 380 R20779_T7 (SEQ ID NO: 354)

These sequences are variants of the known protein Stanniocalcin 2 precursor (SEQ ID NO:379) (SwissProt accession identifier STC2_HUMAN; known also according to the synonyms STC-2; Stanniocalcin-related protein; STCRP; STC-related protein), SEQ ID NO: 379, referred to herein as the previously known protein.

Protein Stanniocalcin 2 precursor (SEQ ID NO:379) is known or believed to have the following function(s): Has an anti-hypocalcemic action on calcium and phosphate homeostasis. The sequence for protein Stanniocalcin 2 precursor (SEQ ID NO:379) is given at the end of the application, as "Stanniocalcin 2 precursor (SEQ ID NO:379) amino acid sequence". Protein Stanniocalcin 2 precursor (SEQ ID NO:379) localization is believed to be Secreted (Potential).

The following GO Annotation(s) apply to the previously known protein. The following annotation(s) were found: cell surface receptor linked signal transduction; cell-cell signaling; nutritional response pathway, which are annotation(s) related to Biological Process; hormone, which are annotation(s) related to Molecular Function; and extracellular, which are annotation(s) related to Cellular Component.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster R20779 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 33 refer to weighted expression of ESTs in each category, as "parts per million" (ratio of the expression of ESTs for a particular cluster to the expression of all ESTs in that category, according to parts per million).

Figure 33:
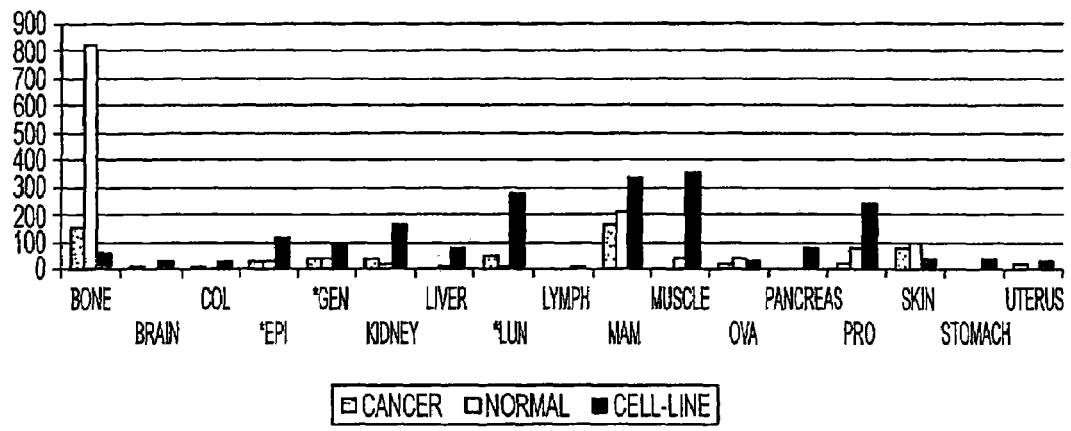
FIG. 33 is a histogram showing Cancer and cell-line vs. normal tissue expression for Cluster R20779, demonstrating overexpression in epithelial malignant tumors, a mixture of malignant tumors from different tissues and lung malignant tumors.

Overall, the following results were obtained as shown with regard to the histograms in FIG. 33 and Table 4. This cluster is overexpressed (at least at a minimum level) in the following pathological conditions: epithelial malignant tumors, a mixture of malignant tumors from different tissues and lung malignant tumors. TABLE-US-00644 TABLE 4 Normal tissue distribution Name of Tissue Number Bone 825 Brain 0 Colon 0 epithelial 32 general 38 kidney 22 Liver 9 Lung 11 Lymph nodes 0 Breast 215 muscle 35 Ovary 36 pancreas 4 prostate 80 Skin 99 stomach 0 Uterus 4

TABLE-US-00645 TABLE 5 P values and ratios for expression in cancerous tissue Name of Tissue P1 P2 SP1 R3 SP2 R4 Bone 5.9e-01 7.4e-01 1 0.2 1 0.1 Brain 2.5e-02 1.6e-02 2.2e-01 6.0 3.5e-02 8.0 Colon 1.7e-01 1.7e-01 1 1.3 7.7e-01 1.5 epithelial 1.7e-01 1.5e-03 5.9e-01 1.0 2.0e-04 2.0 general 2.4e-02 6.2e-07 7.6e-01 0.8 4.6e-05 1.6 kidney 4.3e-01 2.7e-01 6.2e-01 1.3 1.5e-01 2.0 Liver 8.3e-01 7.6e-01 1 0.8 3.3e-01 1.6 Lung 1.2e-01 1.4e-03 1.9e-01 2.9 1.6e-05 7.7 Lymph nodes 1 3.1e-01 1 1.0 1 1.4 Breast 6.8e-01 6.8e-01 6.9e-01 0.8 3.6e-01 0.8 muscle 9.2e-01 4.8e-01 1 0.3 1.4e-03 1.4 Ovary 8.4e-01 7.1-01 9.0e-01 0.7 8.6e-01 0.8 pancreas 9.3e-01 6.8e-01 1 0.7 1.5e-01 2.0 prostate 9.10e-01 5.0e-01 9.8e-01 0.4 5.7e-01 0.7 Skin 6.3e-01 7.5e-01 7.1e-01 0.8 9.5e-01 0.3 stomach 1 4.5e-01 1 1.0 5.1-01 1.8 Uterus 7.1e-01 2.6e-01 4.4e-01 1.7 4.1e-01 1.8

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 6. TABLE-US-00646 TABLE 6 Oligonucleotides related to this cluster Oligonucleotide name Overexpressed in cancers Chip reference R20779_0_0_ 30670 (SEQ breast malignant tumors BRS ID NO: 905)

As noted above, cluster R20779 features 1 transcript(s), which were listed in Table 1 above. These transcript(s) encode for protein(s) which are variant(s) of protein Stanniocalcin 2 precursor (SEQ ID NO:379). A description of each variant protein according to the present invention is now provided.

Variant protein R20779_P2 (SEQ ID NO:380) according to the present invention has an amino acid sequence as given at the end of the application; it is encoded by transcript(s) R20779_T7 (SEQ ID NO:354). An alignment is given to the known protein (Stanniocalcin 2 precursor (SEQ ID NO:379)) at the end of the application. One or more alignments to one or more previously published protein sequences are given at the end of the application. A brief description of the relationship of the variant protein according to the present invention to each such aligned protein is as follows:

Comparison report between R20779_P2 (SEQ ID NO:380) and STC2_HUMAN (SEQ ID NO:379):

1. An isolated chimeric polypeptide encoding for R20779_P2 (SEQ ID NO:380), comprising a first amino acid sequence being at least 90% homologous to MCAERLGQFMTLALVLATFDPARGTDATNPPEG-PQDRSSQQKGRLSLQNTAEIQHCLV NAGDVGCGV-FECFENNSCEIRGLHGICMTFLHNAGKFDAQGKSFIK DALKCKAHALRH RFGCISRKCPAIREMVSQLQRE-CYLKHDLCAAAQENTRVIVEMIHFKDLLLHE corresponding to amino acids 1-169 of STC2_HUMAN (SEQ ID NO:379), which also corresponds to amino acids 1-169 of R20779_P2 (SEQ ID NO:380), and a second amino acid sequence being at least 70%, optionally at least 80%, preferably at least 85%, more preferably at least 90% and most preferably at least 95% homologous to a polypeptide having the sequence CYKIEITMPKRRKVKLRD (SEQ ID NO:976) corresponding to amino acids 170-187 of R20779_P2 (SEQ ID NO:380), wherein said first amino acid sequence and second amino acid sequence are contiguous and in a sequential order.

2. An isolated polypeptide encoding for a tail of R20779_P2 (SEQ ID NO:380), comprising a polypeptide being at least 70%, optionally at least about 80%, preferably at least about 85%, more preferably at least about 90% and most preferably at least about 95% homologous to the sequence CYKIEITMPKRRKVKLRD (SEQ ID NO:976) in R20779_P2 (SEQ ID NO:380).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R20779_P2 (SEQ ID NO:380) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein R20779_P2 (SEQ ID NO:380) sequence provides support for the deduced sequence of this variant protein according to the present invention). TABLE-US-00647 TABLE 7 Amino acid mutations SNP position(s) on Alternative Previously amino acid sequence amino acid(s) known SNP? 16 L→No 98 Q→No 171 Y→C Yes 177 M→V Yes The glycosylation sites of variant protein R20779_P2 (SEQ ID NO:380), as compared to the known protein Stanniocalcin 2 precursor (SEQ ID NO:379), are described in Table 8 (given according to their position(s) on the amino acid sequence in the first column; the second column indicates whether the glycosylation site is present in the variant protein; and the last column indicates whether the position is different on the variant protein). TABLE-US-00648 TABLE 8 Glycosylation site(s) Position(s) on known Present in Position in amino acid sequence variant protein? variant protein? 73 yes 73

Variant protein R20779_P2 (SEQ ID NO:380) is encoded by the following transcript(s): R20779_T7 (SEQ ID NO:354), for which the sequence(s) is/are given at the end of the application. The coding portion of transcript R20779_T7 (SEQ ID NO:354) is shown in bold; this coding portion starts at position 1397 and ends at position 1957. The transcript also has the following SNPs as listed in Table 9 (given according to their position on the nucleotide sequence, with the alternative nucleic acid listed; the last column indicates whether the SNP is known or not; the presence of known SNPs in variant protein R20779_P2 (SEQ ID NO:380) sequence provides support for the deduced sequence of this variant protein according to the present invention). TABLE-US-00649 TABLE 9 Nucleic acid SNPs SNP position on Alternative Previously nucleotide sequence nucleic acid known SNP? 1442 T→No 1690 G→No 1732 C→T Yes 1867 G→T Yes 1908 A→G Yes 1925 A→G Yes 1968 G→A Yes 2087 C→T No 2138 C→T Yes 2270 C→No 2443 A→No 2478 G→No 2479 C→A No 2616 C→A No 2941 C→No 3196→A No 3479 T→G Yes 4290 C→T Yes 4358 G→A Yes 5363 G→A No As noted above, cluster R20779 features 24 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster R20779_node.sub.--0 (SEQ ID NO:355) according to the present invention is supported by 31 libraries. The number of libraries was determined as previously described. This segment can be found in the following transcript(s): R20779_T7 (SEQ ID NO:354). Table 10 below describes the starting and ending position of this segment on each transcript. TABLE-US-00650 TABLE 10 Segment location on transcripts Segment Segment Transcript name starting position ending position R20779_T7 (SEQ ID NO: 354) 1 1298

Segment cluster R20779_node.sub.--2 (SEQ ID NO:356) according to the present invention is supported by 55 libraries. The number of libraries was determined as previously described. This segment can be found in the following transcript(s): R20779_T7 (SEQ ID NO:354). Table 11 below describes the starting and ending position of this segment on each transcript. TABLE-US-00651 TABLE 11 Segment location on transcripts Segment Segment Transcript name starting position ending position R20779_T7 (SEQ ID NO: 354) 1337 1506

Segment cluster R20779_node.sub.--7 (SEQ ID NO:357) according to the present invention is supported by 63 libraries. The number of libraries was determined as previously described. This segment can be found in the following transcript(s): R20779_T7 (SEQ ID NO:354). Table 12 below describes the starting and ending position of this segment on each transcript. TABLE-US-00652 TABLE 12 Segment location on transcripts Segment Segment Transcript name starting position ending position R20779_T7 (SEQ ID NO: 354) 1548 1690

Segment cluster R20779_node.sub.--9 (SEQ ID NO:358) according to the present invention is supported by 66 libraries. The number of libraries was determined as previously described. This segment can be found in the following transcript(s): R20779_T7 (SEQ ID NO:354). Table 13 below describes the starting and ending position of this segment on each transcript. TABLE-US-00653 TABLE 13 Segment location on transcripts Segment Segment Transcript name starting position ending position R20779_T7 (SEQ ID NO: 354) 1691 1838

Segment cluster R20779_node.sub.--18 (SEQ ID NO:359) according to the present invention is supported by 61 libraries. The number of libraries was determined as previously described. This segment can be found in the following transcript(s): R20779_T7 (SEQ ID NO:354). Table 14 below describes the starting and ending position of this segment on each transcript. TABLE-US-00654 TABLE 14 Segment location on transcripts Segment Segment Transcript name starting position ending position R20779_T7 (SEQ ID NO: 354) 2009 2176

Segment cluster R20779_node.sub.--21 (SEQ ID NO:360) according to the present invention is supported by 106 libraries. The number of libraries was determined as previously described. This segment can be found in the following transcript(s): R20779_T7 (SEQ ID NO:354). Table 15 below describes the starting and ending position of this segment on each transcript. TABLE-US-00655 TABLE 15 Segment location on transcripts Segment Segment Transcript name starting position ending position R20779_T7 (SEQ ID NO: 354) 2219 2796

Segment cluster R20779_node.sub.--24 (SEQ ID NO:361) according to the present invention is supported by 100 libraries. The number of libraries was determined as previously described. This segment can be found in the following transcript(s): R20779_T7 (SEQ ID NO:354). Table 16 below describes the starting and ending position of this segment on each transcript. TABLE-US-00656 TABLE 16 Segment location on transcripts Segment Segment Transcript name starting position ending position R20779_T7 (SEQ ID NO: 354) 2977 3667

Segment cluster R20779_node.sub.--27 (SEQ ID NO:362) according to the present invention is supported by 26 libraries. The number of libraries was determined as previously described. This segment can be found in the following transcript(s): R20779_T7 (SEQ ID NO:354). Table 17 below describes the starting and ending position of this segment on each transcript. TABLE-US-00657 TABLE 17 Segment location on transcripts Segment Segment Transcript name starting position ending position R20779_T7 (SEQ ID NO: 354) 3673 3803

Segment cluster R20779_node.sub.--28 (SEQ ID NO:363) according to the present invention is supported by 31 libraries. The number of libraries was determined as previously described. This segment can be found in the following transcript(s): R20779_T7 (SEQ ID NO:354). Table 18 below describes the starting and ending position of this segment on each transcript. TABLE-US-00658 TABLE 18 Segment location on transcripts Segment Segment Transcript name starting position ending position R20779_T7 (SEQ ID NO: 354) 3804 4050

Segment cluster R20779_node.sub.--30 (SEQ ID NO:364) according to the present invention is supported by 34 libraries. The number of libraries was determined as previously described. This segment can be found in the following transcript(s): R20779_T7 (SEQ ID NO:354). Table 19 below describes the starting and ending position of this segment on each transcript. TABLE-US-00659 TABLE 19 Segment location on transcripts Segment Segment Transcript name starting position ending position R20779_T7 (SEQ ID NO: 354) 4068 4193

Segment cluster R20779_node.sub.--31 (SEQ ID NO:365) according to the present invention is supported by 46 libraries. The number of libraries was determined as previously described. This segment can be found in the following transcript(s): R20779_T7 (SEQ ID NO:354). Table 20 below describes the starting and ending position of this segment on each transcript. TABLE-US-00660 TABLE 20 Segment location on transcripts Segment Segment Transcript name starting position ending position R20779_T7 (SEQ ID NO: 354) 4194 4424

Segment cluster R20779_node.sub.--32 (SEQ ID NO:366) according to the present invention is supported by 88 libraries. The number of libraries was determined as previously described. This segment can be found in the following transcript(s): R20779_T7 (SEQ ID NO:354). Table 21 below describes the starting and ending position of this segment on each transcript. TABLE-US-00661 TABLE 21 Segment location on transcripts Segment Segment Transcript name starting position ending position R20779_T7 (SEQ ID NO: 354) 4425 5503

According to an optional embodiment of the present invention, short segments related to the above cluster are also provided. These segments are up to about 120 bp in length, and so are included in a separate description.

Segment cluster R20779_node.sub.--1 (SEQ ID NO:367) according to the present invention is supported by 27 libraries. The number of libraries was determined as previously described. This segment can be found in the following transcript(s): R20779_T7 (SEQ ID NO:354). Table 22 below describes the starting and ending position of this segment on each transcript. TABLE-US-00662 TABLE 22 Segment location on transcripts Segment Segment Transcript name starting position ending position R20779_T7 (SEQ ID NO: 354) 1299 1336

Segment cluster R20779_node.sub.--3 (SEQ ID NO:368) according to the present invention is supported by 52 libraries. The number of libraries was determined as previously described. This segment can be found in the following transcript(s): R20779_T7 (SEQ ID NO:354). Table 23 below describes the starting and ending position of this segment on each transcript. TABLE-US-00663 TABLE 23 Segment location on transcripts Segment Segment Transcript name starting position ending position R20779_T7 (SEQ ID NO: 354) 1507 1547

Segment cluster R20779_node.sub.--10 (SEQ ID NO:369) according to the present invention can be found in the following transcript(s): R20779_T7 (SEQ ID NO:354). Table 24 below describes the starting and ending position of this segment on each transcript. TABLE-US-00664 TABLE 24 Segment location on transcripts Segment Segment Transcript name starting position ending position R20779_T7 (SEQ ID NO: 354) 1839 1849

Segment cluster R20779_node.sub.--11 (SEQ ID NO:370) according to the present invention is supported by 58 libraries. The number of libraries was determined as previously described. This segment can be found in the following transcript(s): R20779_T7 (SEQ ID NO:354). Table 25 below describes the starting and ending position of this segment on each transcript. TABLE-US-00665 TABLE 25 Segment location on transcripts Segment Segment Transcript name starting position ending position R20779_T7 (SEQ ID NO: 354) 1850 1902

Segment cluster R20779_node.sub.--14 (SEQ ID NO:371) according to the present invention is supported by 1 libraries. The number of libraries was determined as previously described. This segment can be found in the following transcript(s): R20779_T7 (SEQ ID NO:354). Table 26 below describes the starting and ending position of this segment on each transcript. TABLE-US-00666 TABLE 26 Segment location on transcripts Segment Segment Transcript name starting position ending position R20779_T7 (SEQ ID NO: 354) 1903 1975

Segment cluster R20779_node.sub.--17 (SEQ ID NO:372) according to the present invention is supported by 54 libraries. The number of libraries was determined as previously described. This segment can be found in the following transcript(s): R20779_T7 (SEQ ID NO:354). Table 27 below describes the starting and ending position of this segment on each transcript. TABLE-US-00667 TABLE 27 Segment location on transcripts Segment Segment Transcript name starting position ending position R20779_T7 (SEQ ID NO: 354) 1976 2008

Segment cluster R20779_node.sub.--19 (SEQ ID NO:373) according to the present invention can be found in the following transcript(s): R20779_T7 (SEQ ID NO:354). Table 28 below describes the starting and ending position of this segment on each transcript. TABLE-US-00668 TABLE 28 Segment location on transcripts Segment Segment Transcript name starting position ending position R20779_T7 (SEQ ID NO: 354) 2177 2188

Segment cluster R20779_node.sub.--20 (SEQ ID NO:374) according to the present invention is supported by 53 libraries. The number of libraries was determined as previously described. This segment can be found in the following transcript(s): R20779_T7 (SEQ ID NO:354). Table 29 below describes the starting and ending position of this segment on each transcript. TABLE-US-00669 TABLE 29 Segment location on transcripts Segment Segment Transcript name starting position ending position R20779_T7 (SEQ ID NO: 354) 2189 2218

Segment cluster R20779_node.sub.--22 (SEQ ID NO:375) according to the present invention is supported by 76 libraries. The number of libraries was determined as previously described. This segment can be found in the following transcript(s): R20779_T7 (SEQ ID NO:354). Table 30 below describes the starting and ending position of this segment on each transcript. TABLE-US-00670 TABLE 30 Segment location on transcripts Segment Segment Transcript name starting position ending position R20779_T7 (SEQ ID NO: 354) 2797 2899

Segment cluster R20779_node.sub.--23 (SEQ ID NO:376) according to the present invention is supported by 81 libraries. The number of libraries was determined as previously described. This segment can be found in the following transcript(s): R20779_T7 (SEQ ID NO:354). Table 31 below describes the starting and ending position of this segment on each transcript. TABLE-US-00671 TABLE 31 Segment location on transcripts Segment Segment Transcript name starting position ending position R20779_T7 (SEQ ID NO: 354) 2900 2976

Segment cluster R20779_node.sub.--25 (SEQ ID NO:377) according to the present invention can be found in the following transcript(s): R20779_T7 (SEQ ID NO:354). Table 32 below describes the starting and ending position of this segment on each transcript. TABLE-US-00672 TABLE 32 Segment location on transcripts Segment Segment Transcript name starting position ending position R20779_T7 (SEQ ID NO: 354) 3668 3672

Segment cluster R20779_node.sub.--29 (SEQ ID NO:378) according to the present invention can be found in the following transcript(s): R20779_T7 (SEQ ID NO:354). Table 33 below describes the starting and ending position of this segment on each transcript. TABLE-US-00673 TABLE 33 Segment location on transcripts Segment Segment Transcript name starting position ending position R20779_T7 (SEQ ID NO: 354) 4051 4067

Variant Protein Alignment to the Previously Known Protein:

Sequence name: STC2_HUMAN (SEQ ID NO:379)

Sequence Documentation:

Alignment of: R20779_P2 (SEQ ID NO:380).times. STC2.sub.13 HUMAN (SEQ ID NO:379).

Alignment segment 1/1: TABLE-US-00674 Quality: 1688.00 Escore: 0 Matching length: 171 Total length: 171

Matching Percent 99.42 Matching Percent 99.42 Similarity: Identity: Total Percent 99.42 Total Percent 99.42 Similarity: Identity: Gaps: 0

```
Alignment: TABLE-US-00675 . . . 1
MCAERLGQFMTLALVLATFDPARGTDATNPPEGPQDRSSQQKGRLSLQNT  50
||||||||||||||||||||||||||||||||||||||||||||||||||   1
MCAERLGQFMTLALVLATFDPARGTDATNPPEGPQDRSSQQKGRLSLQNT  50 . . . 51

AEIQHCLVNAGDVGCGVFECFENNSCEIRGLHGICMTFLHNAGKFDAQGK  100
||||||||||||||||||||||||||||||||||||||||||||||||||   51
AEIQHCLVNAGDVGCGVFECFENNSCEIRGLHGICMTFLHNAGKFDAQGK  100 . . . 101

SFIKDALKCKAHALRHRFGCISRKCPAIREMVSQLQRECYLKHDLCAAAQ  150
||||||||||||||||||||||||||||||||||||||||||||||||||  101
SFIKDALKCKAHALRHRFGCISRKCPAIREMVSQLQRECYLKHDLCAAAQ  150 . . . 151

ENTRVIVEMIHFKDLLLHECY                               171
|||||||||||||||||||||                               151
ENTRVIVEMIHFKDLLLHEPY                               171
```

Description for Cluster HSS100PCB

Cluster HSS100PCB features 1 transcript(s) and 3 segment(s) of interest, the names for which are given in Tables 1 and 2, respectively, the sequences themselves are given at the end of the application. The selected protein variants are given in table 3. TABLE-US-00676 TABLE 1 Transcripts of interest Transcript Name Sequence ID No. HSS100PCB_T1 381

TABLE-US-00677 TABLE 2 Segments of interest Segment Name Sequence ID No. HSS100PCB_node__3 382 HSS100PCB_node__4 383 HSS100PCB_node__5 384

TABLE-US-00678 TABLE 3 Proteins of interest Protein Name Sequence ID No. Corresponding Transcript(s) HSS100PCB_P3 386 HSS100_T1 (SEQ ID NO: 381)

These sequences are variants of the known protein S-100P protein (SEQ ID NO:385) (SwissProt accession identifier S10P_HUMAN), SEQ ID NO: 385, referred to herein as the previously known protein.

The sequence for protein S-100P protein (SEQ ID NO:385) is given at the end of the application, as "S-100P protein (SEQ ID NO:385) amino acid sequence". Known polymorphisms for this sequence are as shown in Table 4. TABLE-US-00679 TABLE 4 Amino acid mutations for Known Protein SNP position(s) on amino acid sequence Comment 32 E→T 44 F→E The following GO Annotation(s) apply to the previously known protein. The following annotation(s) were found: calcium binding; protein binding, which are annotation(s) related to Molecular Function.

The GO assignment relies on information from one or more of the SwissProt/TremBl Protein knowledgebase, available from expasy.ch/sprot/; or Locuslink, available from ncbi.nlm.nih.gov/projects/LocusLink/.

Cluster HSS100PCB can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 34 refer to weighted expression of ESTs in each category, as "parts per million" (ratio of the expression of ESTs for a particular cluster to the expression of all ESTs in that category, according to parts per million).

Figure 34:
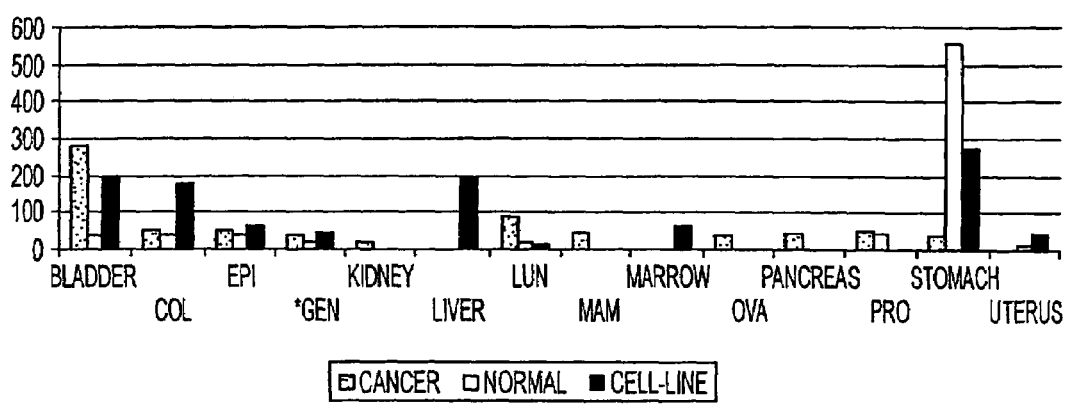
FIG. 34 is a histogram showing Cancer and cell-line vs. normal tissue expression for Cluster HSS100PCB, demonstrating overexpression in a mixture of malignant tumors from different tissues.

Overall, the following results were obtained as shown with regard to the histograms in FIG. 34 and Table 5. This cluster is overexpressed (at least at a minimum level) in the following pathological conditions: a mixture of malignant tumors from different tissues. TABLE-US-00680 TABLE 5 Normal tissue distribution Name of Tissue Number Bladder 41 Colon 37 Epithelial 38 General 22 Kidney 0 Liver 0 Lung 18 Breast 0 bone marrow 0 Ovary 0 pancreas 0 prostate 46 stomach 553 Uterus 13

TABLE-US-00681 TABLE 6 P values and ratios for expression in cancerous tissue Name of Tissue P1 P2 SP1 R3 SP2 R4 bladder 3.3e-01 2.9e-01 2.9e-02 2.8 3.5e-02 2.8 Colon 3.0e-01 1.9e-01 5.2e-01 1.2 2.4e-01 1.7 epithelial 4.7e-02 1.6e-02 2.0e-01 1.2 6.1e-02 1.3 general 1.1e-03 6.8e-05 1.4e-02 1.5 4.9e-04 1.7 kidney 6.5e-01 7.2e-01 5.8e-01 1.7 7.0e-01 1.4 Liver 9.1e-01 4.9e-01 1 1.0 7.7e-02 2.1 Lung 6.8e-01 7.3e-01 2.2e-02 2.9 1.3e-01 1.7 Breast 2.8e-01 3.2e-01 4.7e-01 2.0 6.8e-01 1.5 bone marrow 1 6.7e-01 1 1.0 2.8e-01 2.8 Ovary 2.6e-01 3.0e-01 4.7e-01 2.0 5.9e-01 1.7 pancreas 3.3e-01 4.4e-01 7.6e-02 3.7 1.5e-01 2.8 prostate 9.1e-01 9.3e-01 5.8e-01 0.6 7.6e-01 0.5 stomach 3.7e-01 3.2e-01 1 0.1 1 0.3 Uterus 9.4e-01 7.0e-01 1 0.64.1e-01 1.1

As noted above, cluster HSS100PCB features 1 transcript(s), which were listed in Table 1 above. These transcript(s) encode for protein(s) which are variant(s) of protein S-100P protein (SEQ ID NO:385). A description of each variant protein according to the present invention is now provided.

Variant protein HSS100PCB_P3 (SEQ ID NO:386) according to the present invention has an amino acid sequence as given at the end of the application; it is encoded by transcript(s) HSS100PCB_T1 (SEQ ID NO:381). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSS100PCB_P3 (SEQ ID NO:386) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein HSS100PCB_P3 (SEQ ID NO:386) sequence provides support for the deduced sequence of this variant protein according to the present invention). TABLE-US-00682 TABLE 7 Amino acid mutations SNP position(s) on Alternative Previously amino acid sequence amino acid(s) known SNP? 1 M→R Yes 11 M→L Yes 20 L→F Yes Variant protein HSS100PCB_P3 (SEQ ID NO:386) is encoded by the following transcript(s): HSS100PCB_T1 (SEQ ID NO:381), for which the sequence(s) is/are given at the end of the application. The coding portion of transcript HSS100PCB_T1 (SEQ ID NO:381) is shown in bold; this coding portion starts at position 1057 and ends at position 1533. The transcript also has the following SNPs as listed in Table 8 (given according to their position on the nucleotide sequence, with the alternative nucleic acid listed; the last column indicates whether the SNP is known or not; the presence of known SNPs in variant protein HSS100PCB_P3 (SEQ ID NO:386) sequence provides support for the deduced sequence of this variant protein according to the present invention). TABLE-US-00683 TABLE 8 Nucleic acid SNPs SNP position on Alternative Previously nucleotide sequence nucleic acid known SNP? 52 C→T Yes 107 A→C Yes 458 C→T Yes 468 A→G Yes 648 C→T Yes 846 C→G Yes 882 G→A Yes 960 C→T No 965 C→T Yes 1058 T→G Yes 1087A→C Yes 1114 C→T Yes 1968 G→A Yes 1971 C→T Yes 2010 C→A Yes 2099 G→No As noted above, cluster HSS100PCB features 3 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSS100PCB_node.sub.--3 (SEQ ID NO:382) according to the present invention is supported by 16 libraries. The number of libraries was determined as previously described. This segment can be found in the following transcript(s): HSS100PCB_T1 (SEQ ID NO:381). Table 9 below describes the starting and ending position of this segment on each transcript. TABLE-US-00684 TABLE 9 Segment location on transcripts Segment Segment Transcript name starting position ending position HSS100PCB_T1 (SEQ ID NO: 381) 1 1133

Segment cluster HSS100PCB_node.sub.--4 (SEQ ID NO:383) according to the present invention is supported by 29 libraries. The number of libraries was determined as previously described. This segment can be found in the following transcript(s): HSS100PCB_T1 (SEQ ID NO:381). Table 10 below describes the starting and ending position of this segment on each transcript. TABLE-US-00685 TABLE 10 Segment location on transcripts Segment Segment Transcript name starting position ending position HSS100PCB_T1 (SEQ ID NO: 381) 1134 1923

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to breast cancer), shown in Table 11. TABLE-US-00686 TABLE 11 Oligonucleotides related to this segment Oligonucleotide name Overexpressed in cancers Chip reference HSS100PCB_0_0_12280 breast malignant tumors BRS (SEQ ID NO: 906)

Segment cluster HSS100PCB_node.sub.--5 (SEQ ID NO:384) according to the present invention is supported by 141 libraries. The number of libraries was determined as previously described. This segment can be found in the following transcript(s): HSS100PCB_T1 (SEQ ID NO:381). Table 12 below describes the starting and ending position of this segment on each transcript. TABLE-US-00687 TABLE 12 Segment location on transcripts Segment Segment Transcript name starting position ending position HSS100PCB_T1 (SEQ ID NO: 381) 1924 2201

Description for Cluster HSCOC4

Cluster HSCOC4 features 19 transcript(s) and 79 segment(s) of interest, the names for which are given in Tables 1 and 2, respectively, the sequences themselves are given at the end of the application. The selected protein variants are given in table 3. TABLE-US-00688 TABLE 1 Transcripts of interest Transcript Name Sequence ID No. HSCOC4_PEA_1_T1 387 HSCOC4_PEA_1_T2 388 HSCOC4_PEA_1_T3 389 HSCOC4_PEA_1_T4 390 HSCOC4_PEA_1_T5 391 HSCOC4_PEA_1_T7 392 HSCOC4_PEA_1_T8 393 HSCOC4_PEA_1_T11 394 HSCOC4_PEA_1_T12 395 HSCOC4_PEA_1_T14 396 HSCOC4_PEA_1_T15 397 HSCOC4_PEA_1_T20 398 HSCOC4_PEA_1_T21 399 HSCOC4_PEA_1_T25 400 HSCOC4_PEA_1_T28 401 HSCOC4_PEA_1_T30 402 HSCOC4_PEA_1_T31 403 HSCOC4_PEA_1_T32 404 HSCOC4_PEA_1_T40 405

TABLE-US-00689 TABLE 2 Segments of interest Segment Name Sequence ID No. HSCOC4_PEA_1_node_1 406 HSCOC4_PEA_1_node_5 407 HSCOC4_PEA_1_node_7 408 HSCOC4_PEA_1_node_30 409 HSCOC4_PEA_1_node_33 410 HSCOC4_PEA_1_node_35 411 HSCOC4_PEA_1_node_37 412 HSCOC4_PEA_1_node_39 413 HSCOC4_PEA_1_node_43 414 HSCOC4_PEA_1_node_48 415 HSCOC4_PEA_1_node_49 416 HSCOC4_PEA_1_node_51 417 HSCOC4_PEA_1_node_58 418 HSCOC4_PEA_1_node_59 419 HSCOC4_PEA_1_node_62 420 HSCOC4_PEA_1_node_66 421 HSCOC4_PEA_1_node_72 422 HSCOC4_PEA_1_node_77 423 HSCOC4_PEA_1_node_79 424 HSCOC4_PEA_1_node_93 425 HSCOC4_PEA_1_node_100 426 HSCOC4_PEA_1_node_105 427 HSCOC4_PEA_1_node_107 428 HSCOC4_PEA_1_node_108 429 HSCOC4_PEA_1_node_109 430 HSCOC4_PEA_1_node_110 431 HSCOC4_PEA_1_node_112 432 HSCOC4_PEA_1_node_113 433 HSCOC4_PEA_1_node_2 434 HSCOC4_PEA_1_node_8 435 HSCOC4_PEA_1_node_10 436 HSCOC4_PEA_1_node_12 437 HSCOC4_PEA_1_node_14 438 HSCOC4_PEA_1_node_17 439 HSCOC4_PEA_1_node_19 440 HSCOC4_PEA_1_node_21 441 HSCOC4_PEA_1_node_22 442 HSCOC4_PEA_1_node_28 443 HSCOC4_PEA_1_node_29 444 HSCOC4_PEA_1_node_41 445 HSCOC4_PEA_1_node_45 446 HSCOC4_PEA_1_node_47 447 HSCOC4_PEA_1_node_50 448 HSCOC4_PEA_1_node_53 449 HSCOC4_PEA_1_node_55 450 HSCOC4_PEA_1_node_57 451 HSCOC4_PEA_1_node_60 452 HSCOC4_PEA_1_node_64 453 HSCOC4_PEA_1_node_69 454 HSCOC4_PEA_1_node_70 455 HSCOC4_PEA_1_node_71 456 HSCOC4_PEA_1_node_73 457 HSCOC4_PEA_1_node_74 458 HSCOC4_PEA_1_node_75 459 HSCOC4_PEA_1_node_76 460 HSCOC4_PEA_1_node_78 461 HSCOC4_PEA_1_node_80 462 HSCOC4_PEA_1_node_82 463 HSCOC4_PEA_1_node_83 464 HSCOC4_PEA_1_node_84 465 HSCOC4_PEA_1_node_85 466 HSCOC4_PEA_1_node_86 467 HSCOC4_PEA_1_node_87 468 HSCOC4_PEA_1_node_88 469 HSCOC4_PEA_1_node_89 470 HSCOC4_PEA_1_node_90 471 HSCOC4_PEA_1_node_91 472 HSCOC4_PEA_1_node_92 473 HSCOC4_PEA_1_node_94 474 HSCOC4_PEA_1_node_96 475 HSCOC4_PEA_1_node_97 476 HSCOC4_PEA_1_node_98 477 HSCOC4_PEA_1_node_99 478

HSCOC4_PEA_1_node_101 479 HSCOC4_PEA_1_node_102 480 HSCOC4_PEA_1_node_103 481 HSCOC4_PEA_1_node_104 482 HSCOC4_PEA_1_node_106 483 HSCOC4_PEA_1_node_111 484

TABLE-US-00690 TABLE 3 Proteins of interest Sequence Protein Name ID No. Corresponding Transcript(s) HSCOC4_PEA_1_P3 488 HSCOC4_PEA_1_T1 (SEQ ID NO: 387) HSCOC4_PEA_1_P5 489 HSCOC4_PEA_1_T3 (SEQ ID NO: 389) HSCOC4_PEA_1_P6 490 HSCOC4_PEA_1_T4 (SEQ ID NO: 390) HSCOC4_PEA_1_P12 491 HSCOC4_PEA_1_T11 (SEQ ID NO: 394) HSCOC4_PEA_1_P15 492 HSCOC4_PEA_1_T14 (SEQ ID NO: 396) HSCOC4_PEA_1_P16 493 HSCOC4_PEA_1_T15 (SEQ ID NO: 397) HSCOC4_PEA_1_P20 494 HSCOC4_PEA_1_T20 (SEQ ID NO: 398) HSCOC4_PEA_1_P9 495 HSCOC4_PEA_1_T21 (SEQ ID NO: 399) HSCOC4_PEA_1_P22 496 HSCOC4_PEA_1_T25 (SEQ ID NO: 400) HSCOC4_PEA_1_P23 497 HSCOC4_PEA_1_T28 (SEQ ID NO: 401) HSCOC4_PEA_1_P24 498 HSCOC4_PEA_1_T30 (SEQ ID NO: 402) HSCOC4_PEA_1_P25 499 HSCOC4_PEA_1_T31 (SEQ ID NO: 403) HSCOC4_PEA_1_P26 500 HSCOC4_PEA_1_T32 (SEQ ID NO: 404) HSCOC4_PEA_1_P30 501 HSCOC4_PEA_1_T40 (SEQ ID NO: 405) HSCOC4_PEA_1_P38 502 HSCOC4_PEA_1_T2 (SEQ ID NO: 388) HSCOC4_PEA_1_P39 503 HSCOC4_PEA_1_T5 (SEQ ID NO: 391) HSCOC4_PEA_1_P40 504 HSCOC4_PEA_1_T7 (SEQ ID NO: 392) HSCOC4_PEA_1_P41 505 HSCOC4_PEA_1_T8 (SEQ ID NO: 393) HSCOC4_PEA_1_P42 506 HSCOC4_PEA_1_T12 (SEQ ID NO: 395)

These sequences are variants of the known protein Complement C4 precursor [Contains: C4a anaphylatoxin] (SwissProt accession identifier CO4_HUMAN) SEQ ID NO: 485), referred to herein as the previously known protein.

Protein Complement C4 precursor [Contains: C4a anaphylatoxin] (SEQ ID NO:485) is known or believed to have the following function(s): C4 plays a central role in the activation of the classical pathway of the complement system. It is processed by activated C1 which removes from the alpha chain the C4a anaphylatoxin. Derived from proteolytic degradation of complement C4, C4a anaphylatoxin is a mediator of local inflammatory process. It induces the contraction of smooth muscle, increases vascular permeability and causes histamine release from mast cells and basophilic leukocytes. The sequence for protein Complement C4 precursor [Contains: C4a anaphylatoxin] (SEQ ID NO:485) is given at the end of the application, as "Complement C4 precursor [Contains: C4a anaphylatoxin] (SEQ ID NO:485) amino acid sequence". Known polymorphisms for this sequence are as shown in Table 4. TABLE-US-00691 TABLE 4 Amino acid mutations for Known Protein SNP position(s) on amino acid sequence Comment 477 R→W (in allotype C4A6). /FTId=VAR_001987. 726 P→L (in allotype C4A3). /FTId=VAR_001988. 1073 D→G (in allotype C4A1, allotype C4B1 and allotype C4B3). /FTId=VAR_001989. 1120-1125 PCPVLD→LSPVIH (in allotype C4B). /FTId=VAR_001990.1176 N→S (in allotype C4A1, allotype C4B1, allotype C4B3 and allotype C4B5). /FTId=VAR_001991. 1201 S→T (in allotype C4A6, allotype C4A3, allotype C4A1 and allotype C4B). /FTId=VAR_001992. 1207 V→A (in allotype C4A1, allotype C4B1, allotype C4B2 and allotype C4B3). /FTId=VAR_001993. 1210 L→R (in allotype C4A1, allotype C4B1, allotype C4B2 and allotype C4B3). /FTId=VAR_001994. 1286 S→A (in allotype C4A6, allotype C4A1, allotype C4A3A and allotype C4B). /FTId=VAR_001995.1-12 MRLLWGLIWASS→PREVRSVCLSAT 347 S→Y 418 V→A 727 D→N 907 A→T 980-981 VT→LQ 1013 Q→E 1317 I→F 1418-1420 Missing 1654 T→RA 1698 H→Q The following GO Annotation(s) apply to the previously known protein. The following annotation(s) were found: muscle contraction regulation; inflammatory response; complement activation; complement activation, classical pathway, which are annotation(s) related to Biological Process; complement component; proteinase inhibitor, which are annotation(s) related to Molecular Function; and extracellular; extracellular space, which are annotation(s) related to Cellular Component.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster HSCOC4 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 35 refer to weighted expression of ESTs in each category, as "parts per million" (ratio of the expression of ESTs for a particular cluster to the expression of all ESTs in that category, according to parts per million).

Figure 35:
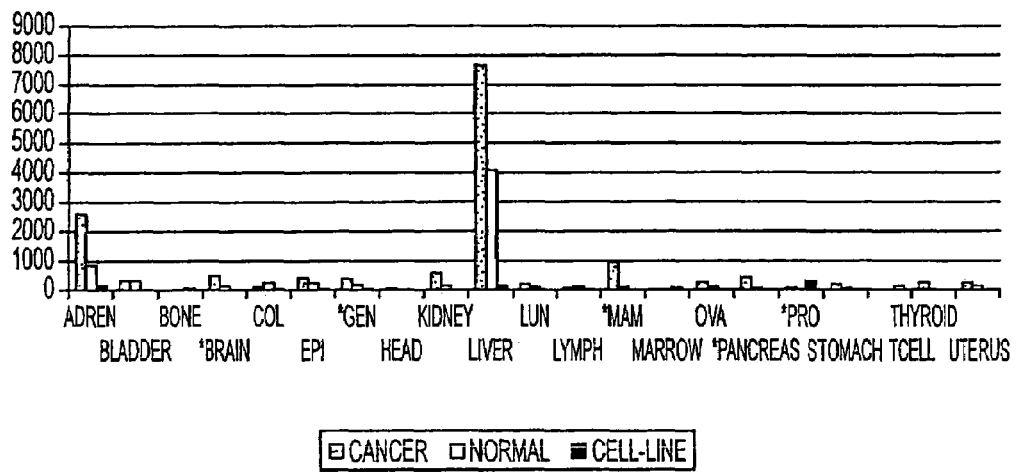
FIG. 35 is a histogram showing Cancer and cell-line vs. normal tissue expression for Cluster HSCOC4, demonstrating overexpression in brain malignant tumors, a mixture of malignant tumors from different-tissues, breast malignant tumors, pancreas carcinoma and prostate cancer.

Overall, the following results were obtained as shown with regard to the histograms in FIG. 35 and Table 5. This cluster is overexpressed (at least at a minimum level) in the following pathological conditions: brain malignant tumors, a mixture of malignant tumors from different tissues, breast malignant tumors, pancreas carcinoma and prostate cancer. TABLE-US-00692 TABLE 5 Normal tissue distribution Name of Tissue Number adrenal 853 bladder 328 bone 6 brain 111 colon 245 epithelial 264 general 163 head and neck 0 kidney 141 liver 4109 lung 64 lymph nodes 120 breast 96 bone marrow 0 ovary 116 pancreas 20 prostate 4 stomach 36 T cells 0 Thyroid 12 uterus 127

TABLE-US-00693 TABLE 6 P values and ratios for expression in cancerous tissue Name of Tissue P1 P2 SP1 R3 SP2 R4 adrenal 5.6e-01 5.9e-01 2.5e-06 0.3 4.3e-04 0.3 bladder 5.0e-01 6.6e-01 6.3e-01 0.9 9.1e-01 0.6 bone 5.5e-01 5.8e-01 1 1.1 7.0e-01 1.3 brain 4.6e-03 6.2e-02 7.7e-11 3.0 3.2e-05 1.7 colon 8.0e-01 8.3e-01 9.8e-01 0.4 9.9e-01 0.4 epithelial 1.7e-01 9.2e-01 9.3e-07 1.3 9.7e-01 0.7 general 3.2e-04 6.1e-01 1.5e-31 2.1 1.9e-03 1.1 head and neck 1.2e-01 2.1e-01 1 1.2 1 1.1 kidney 6.9e-01 8.1e-01 1.2e-04 2.4 1.5e-02 1.5 liver 7.1e-01 7.2e-01 5.0e-04 0.2 1 0.1 lung 2.9e-01 7.1e-01 4.2e-02 1.7 5.1e-01 0.8 lymph nodes 6.3e-01 8.2e-01 9.0e-01 0.5 1 0.3 breast 4.0e-02 1.8e-01 2.1e-06 6.0 3.9e-03 3.0 bone marrow 1 6.7e-01 1 1.0 2.8e-01 2.8 ovary 6.6e-01 7.3e-01 1.3e-01 1.5 3.6e-01 1.1 pancreas 1.7e-02 9.9e-02 4.8e-10 7.6 2.9e-07 5.1 prostate 5.8e-01 6.3e-01 4.1e-02 3.9 1.8e-03 3.8 stomach 2.7e-01 7.5e-01 1.1e-01 1.5 6.5e-01 0.8 T cells 1 6.7e-01 1 1.0 7.2e-01 1.4 Thyroid 3.4e-01 3.4e-01 3.0e-01 2.2 3.0e-01 2.2 uterus 1.2e-01 5.3e-01 6.6e-02 1.4 5.4e-01 0.8

As noted above, cluster HSCOC4 features 19 transcript(s), which were listed in Table 1 above. These transcript(s) encode for protein(s) which are variant(s) of protein Complement C4 precursor [Contains: C4a anaphylatoxin]. A description of each variant protein according to the present invention is now provided.

Variant protein HSCOC4_PEA.sub.--1_P3 (SEQ ID NO:488) according to the present invention has an amino acid sequence as given at the end of the application; it is encoded by transcript(s) HSCOC4_PEA.sub.--1_T1 (SEQ ID NO:387). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P3 (SEQ ID NO:488) and CO4_HUMAN (SEQ ID NO:485):

1. An isolated chimeric polypeptide encoding for HSCOC4_PEA.sub.--1_P3 (SEQ ID NO:488), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIARLTVMPPSGGPGFLSIERPD SRPPRVGDTLNLNLRAVGSGATFSHY-YYMILSRGQIVFMNREPKRTLTSVSVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTV corresponding to amino acids 1-865 of CO4_HUMAN (SEQ ID NO:485), which also corresponds to amino acids 1-865 of HSCOC4_PEA.sub.--1_P3 (SEQ ID NO:488), and a second amino acid sequence being at least 70%, optionally at least 80%, preferably at least 85%, more preferably at least 90% and most preferably at least 95% homologous to a polypeptide having the sequence RPHRSL-SIQELGEPGPSEGWGG (SEQ ID NO:977) corresponding to amino acids 866-887 of HSCOC4_PEA.sub.--1_P3 (SEQ ID NO:488), wherein said first amino acid sequence and second amino acid sequence are contiguous and in a sequential order.

2. An isolated polypeptide encoding for a tail of HSCOC4_PEA.sub.--1_P3 (SEQ ID NO:488), comprising a polypeptide being at least 70%, optionally at least about 80%, preferably at least about 85%, more preferably at least about 90% and most preferably at least about 95% homologous to the sequence RPHRSLSIQELGEPGPSEGWGG (SEQ ID NO:977) in HSCOC4_PEA.sub.--1_P3 (SEQ ID NO:488).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P3 (SEQ ID NO:488) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein HSCOC4_PEA.sub.--1_P3 (SEQ ID NO:488) sequence provides support for the deduced sequence of this variant protein according to the present invention). TABLE-US-00694 TABLE 7 Amino acid mutations SNP position(s) on Alternative Previously amino acid sequence amino acid(s) known SNP? 128 Q→No 141 L→V Yes 183 G→No 211 G→No 322 A→No 322 A→V No 347 S→Y Yes 423 Q→No 478 P→L Yes 549 H→P Yes 608 L→V Yes 617 K→E Yes 726 P→L Yes 869 R→G Yes The glycosylation sites of variant protein HSCOC4_PEA.sub.--1_P3 (SEQ ID NO:488), as compared to the known protein Complement C4 precursor [Contains: C4a anaphylatoxin], are described in Table 8 (given according to their position(s) on the amino acid sequence in the first column; the second column indicates whether the glycosylation site is present in the variant protein; and the last column indicates whether the position is different on the variant protein). TABLE-US-00695 TABLE 8 Glycosylation site(s) Position(s) on known Present in Position in amino acid sequence variant protein? variant protein? 1391 no 862 yes 862 226 yes 226 1328 no The phosphorylation sites of variant protein HSCOC4_PEA.sub.--1_P3 (SEQ ID NO:488), as compared to the known protein Complement C4 precursor [Contains: C4a anaphylatoxin], are described in Table 9 (given according to their position(s) on the amino acid sequence in the first column; the second column indicates whether the phosphorylation site is present in the variant protein; and the last column indicates whether the position is different on the variant protein). TABLE-US-00696 TABLE 9 Phosphorylation site(s) Position(s) on known Present in Position in amino acid sequence variant protein? variant protein? 1420 no 1422 no 1417 no Variant protein HSCOC4_PEA.sub.--1_P3 (SEQ ID NO:488) is encoded by the following transcript(s): HSCOC4_PEA.sub.--1_T1 (SEQ ID NO:387), for which the sequence(s) is/are given at the end of the application. The coding portion of transcript HSCOC4_PEA.sub.--1_T1 (SEQ ID NO:387) is shown in bold; this coding portion starts at position 501 and ends at position 3161. The transcript also has the following SNPs as listed in Table 10 (given according to their position on the nucleotide sequence, with the alternative nucleic acid listed; the last column indicates whether the SNP is known or not; the presence of known SNPs in variant protein HSCOC4_PEA.sub.--1_P3 (SEQ ID NO:488) sequence provides support for the deduced sequence of this variant protein according to the present invention). TABLE-US-00697 TABLE 10 Nucleic acid SNPs SNP position on Alternative Previously nucleotide sequence nucleic acid known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3105 A→G Yes 3167 G→A Yes 3228 T→C Yes 3259 G→T Yes 3332 G→A Yes 3490 A→C Yes 3569 T→C Yes 3724 G→T Yes 3831 A→G Yes 3898 C→A Yes 3972 C→T Yes 3975 G→C Yes 3983 T→A Yes 3986 G→C Yes 3988 C→T Yes 4140 G→A Yes 4147 T→C Yes 4228 C→G Yes 4233 C→T Yes 4242 G→T Yes 4243 G→C Yes 4339 G→A Yes 4345 C→G Yes 4348 G→A Yes 4469 G→T Yes 4562 A→T Yes 4781 A→G No 4873 T→C Yes 5007 G→No 5423 C→G Yes 5634 G→C No 5677 G→A Yes 5687 A→C Yes 5862 A→C Yes 5868 G→A Yes 5933 A→C Yes Variant protein HSCOC4_PEA.sub.--1_P5 (SEQ ID NO:489) according to the present invention has an amino acid sequence as given at the end of the application; it is encoded by transcript(s) HSCOC4_PEA.sub.--1_T3 (SEQ ID NO:389). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P5 (SEQ ID NO:489) and CO4_HUMAN (SEQ ID NO:485):

1. An isolated chimeric polypeptide encoding for HSCOC4_PEA.sub.--1_P5 (SEQ ID NO:489), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIARLTVMPPSGGPGFLSIERPD SRPPRVGDTLNLNLRAVGSGATFSHY-YYMILSRGQIVFMNREPKRTLTSVSVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKG corresponding to amino acids 1-818 of CO4_HUMAN (SEQ ID NO:485), which also corresponds to amino acids 1-818 of HSCOC4_PEA.sub.--1_P5 (SEQ ID NO:489), and a second amino acid sequence being at least 70%, optionally at least 80%, preferably at least 85%, more preferably at least 90% and most preferably at least 95% homologous to a polypeptide having the sequence DVTLSGPQVTLLPFPCTPAPCS-LCS (SEQ ID NO:978) corresponding to amino acids 819-843 of HSCOC4_PEA.sub.--1_P5 (SEQ ID NO:489), wherein said first amino acid sequence and second amino acid sequence are contiguous and in a sequential order.

2. An isolated polypeptide encoding for a tail of HSCOC4_PEA.sub.--1_P5 (SEQ ID NO:489), comprising a polypeptide being at least 70%, optionally at least about 80%, preferably at least about 85%, more preferably at least about 90% and most preferably at least about 95% homologous to the sequence DVTLSGPQVTLLPFPCTPAPCSLCS (SEQ ID NO:978) in HSCOC4_PEA.sub.--1_P5 (SEQ ID NO:489).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P5 (SEQ ID NO:489) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein HSCOC4_PEA.sub.--1_P5 (SEQ ID NO:489) sequence provides support for the deduced sequence of this variant protein according to the present invention). TABLE-US-00698 TABLE 11 Amino acid mutations SNP position(s) on Alternative Previously amino acid sequence amino acid(s) known SNP? 128 Q→No 141 L→V Yes 183 G→No 211 G→No 322 A→No 322 A→V No 347 S→Y Yes 423 Q→No 478 P→L Yes 549 H→P Yes 608 L→V Yes 617 K→E Yes 726 P→L Yes 829 L→P Yes 830 L→I Yes 840 S→P Yes The glycosylation sites of variant protein HSCOC4_PEA.sub.--1_P5 (SEQ ID NO:489), as compared to the known protein Complement C4 precursor [Contains: C4a anaphylatoxin], are described in Table 12 (given according to their position(s) on the amino acid sequence in the first column; the second column indicates whether the glycosylation site is present in the variant protein; and the last column indicates whether the position is different on the variant protein). TABLE-US-00699 TABLE 12 Glycosylation site(s) Position(s) on known Present in Position in amino acid sequence variant protein? variant protein? 1391 no 862 no 226 yes 226 1328 no The phosphorylation sites of variant protein HSCOC4_PEA.sub.--1_P5 (SEQ ID NO:489), as compared to the known protein Complement C4 precursor [Contains: C4a anaphylatoxin], are described in Table 13 (given according to their position(s) on the amino acid sequence in the first column; the second column indicates whether the phosphorylation site is present in the variant protein; and the last column indicates whether the position is different on the variant protein). TABLE-US-00700 TABLE 13 Phosphorylation site(s) Position(s) on known amino acid sequence Present in variant protein? 1420 no 1422 no 1417 no Variant protein HSCOC4_PEA.sub.--1_P5 (SEQ ID NO:489) is encoded by the following transcript(s): HSCOC4_PEA.sub.--1_T3 (SEQ ID NO:389), for which the sequence(s) is/are given at the end of the application. The coding portion of transcript HSCOC4_PEA.sub.--1_T3 (SEQ ID NO:389) is shown in bold; this coding portion starts at position 501 and ends at position 3029. The transcript also has the following SNPs as listed in Table 14 (given according to their position on the nucleotide sequence, with the alternative nucleic acid listed; the last column indicates whether the SNP is known or not; the presence of known SNPs in variant protein HSCOC4_PEA_I_P5 (SEQ ID NO:489) sequence provides support for the deduced sequence of this variant protein according to the present invention). TABLE-US-00701 TABLE 14 Nucleic acid SNPs SNP position on nucleotide Alternative sequence nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2986 T→C Yes 2988 C→A Yes 3018 T→C Yes 3070 C→T Yes 3081 C→A Yes 3093 A→G Yes 3101 G→A Yes 3106 G→A Yes 3174 G→A Yes 3193 A→G Yes 3201 T→C Yes 3233 C→T Yes 3363 A→G Yes 3425 G→A Yes 3486 T→C Yes 3517 G→T Yes 3590 G→A Yes 3748 A→C Yes 3827 T→C Yes 3982 G→T Yes 4089 A→G Yes 4156 C→A Yes 4230 C→T Yes 4233 G→C Yes 4241 T→A Yes 4244 G→C Yes 4246 C→T Yes 4398 G→A Yes 4405 T→C Yes 4486 C→G Yes 4491 C→T Yes 4500 G→T Yes 4501 G→C Yes 4597 G→A Yes 4603 C→G Yes 4606 G→A Yes 4727 G→T Yes 4820 A→T Yes 5039 A→G No 5131 T→C Yes 5265 G→No 5681 C→G Yes 5892 G→C No 5935 G→A Yes 5945 A→C Yes 6120 A→C Yes 6126 G→A Yes 6191 A→C Yes Variant protein HSCOC4_PEA.sub.--1_P6 (SEQ ID NO:490) according to the present invention has an amino acid sequence as given at the end of the application; it is encoded by transcript(s) HSCOC4_PEA.sub.--1_T4 (SEQ ID NO:390). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P6 (SEQ ID NO:490) and CO4_HUMAN (SEQ ID NO:485):

1. An isolated chimeric polypeptide encoding for HSCOC4_PEA.sub.--1_P6 (SEQ ID NO:490), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIARLTVMPPSGGPGFLSIERPD SRPPRVGDTLNLNLRAVGSGATFSHY-YYMILSRGQIVFMNREPKRTLTSVSVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLMSRYLDKTE-QWSTLPPETKDHAVDLIQKG corresponding to amino acids 1-1052 of CO4_HUMAN (SEQ ID NO:485), which also corresponds to amino acids 1-1052 of HSCOC4_PEA.sub.--1_P6 (SEQ ID NO:490), and a second amino acid sequence being at least 70%, optionally at least 80%, preferably at least 85%, more preferably at least 90% and most preferably at least 95% homologous to a polypeptide having the sequence SGCKGKQEGGQERTVTGR-WTAQEATEGKKGGP (SEQ ID NO:979) corresponding to amino acids 1053-1084 of HSCOC4_PEA.sub.--1_P6 (SEQ ID NO:490), wherein said first amino acid sequence and second amino acid sequence are contiguous and in a sequential order.

2. An isolated polypeptide encoding for a tail of HSCOC4_PEA.sub.--1_P6 (SEQ ID NO:490), comprising a polypeptide being at least 70%, optionally at least about 80%, preferably at least about 85%, more preferably at least about 90% and most preferably at least about 95% homologous to the sequence SGCKGKQEGGQERTVTGR-WTAQEATEGKKGGP (SEQ ID NO:979) in HSCOC4_PEA.sub.--1_P6 (SEQ ID NO:490).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P6 (SEQ ID NO:490) also has the following non-silent SNPs (Single Nucleotide Polymorphisms) as listed in Table 15, (given according to their position(s) on the amino acid sequence, with the alternative amino acid(s) listed; the last column indicates whether the SNP is known or not; the presence of known SNPs in variant protein HSCOC4_PEA.sub.--1_P6 (SEQ ID NO:490) sequence provides support for the deduced sequence of this variant protein according to the present invention). TABLE-US-00702 TABLE 15 Amino acid mutations SNP position(s) on amino acid Alternative sequence amino acid(s) Previously known SNP? 128 Q→No 141 L→V Yes 183 G→No 211 G→No 322 A→No 322 A→V No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1062 G→V Yes 1068 T→Yes The glycosylation sites of variant protein HSCOC4_PEA.sub.--1_P6 (SEQ ID NO:490), as compared to the known protein Complement C4 precursor [Contains: C4a anaphylatoxin], are described in Table 16 (given according to their position(s) on the amino acid sequence in the column; the second column indicates whether the glycosylation site is present in the variant protein; and the last column indicates whether the position is different on the variant protein). TABLE-US-00703 TABLE 16 Glycosylation site(s) Position(s) on known amino Present in acid sequence variant protein? Position in variant protein? 1391 no 862 yes 862 226 yes 226 1328 no The phosphorylation sites of variant protein HSCOC4_PEA.sub.--1_P6 (SEQ ID NO:490), as compared to the known protein Complement C4 precursor [Contains: C4a anaphylatoxin], are described in Table 17 (given according to their position(s) on the amino acid sequence in the column; the second column indicates whether the phosphorylation site is present in the variant protein; and the last column indicates whether the position is different on the variant protein). TABLE-US-00704 TABLE 17 Phosphorylation site(s) Position(s) on known amino acid sequence Present in variant protein? 1420 no 1422 no 1417 no Variant protein HSCOC4_PEA.sub.--1_P6 (SEQ ID NO:490) is encoded by the following transcript(s): HSCOC4_PEA.sub.--1_T4 (SEQ ID NO:390), for which the sequence(s) is/are given at the end of the application. The coding portion of transcript HSCOC4_PEA.sub.--1_T4 (SEQ ID NO:390) is shown in bold; this coding portion starts at position 501 and ends at position 3752. The transcript also has the following SNPs as listed in Table 18 (given according to their position on the nucleotide sequence, with the alternative nucleic acid listed; the last column indicates whether the SNP is known or not; the presence of known SNPs in variant protein HSCOC4_PEA.sub.--1_P6 (SEQ ID NO:490) sequence provides support for the deduced sequence of this variant protein according to the present invention). TABLE-US-00705 TABLE 18 Nucleic acid SNPs SNP position on nucleotide Alternative sequence nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3685 G→T Yes 3702 A→Yes 3897 A→G Yes 3964 C→A Yes 4038 C→T Yes 4041 G→C Yes 4049 T→A Yes 4052 G→C Yes 4054 C→T Yes 4206 G→A Yes 4213 T→C Yes 4294 C→G Yes 4299 C→T Yes 4308 G→T Yes 4309 G→C Yes 4405 G→A Yes 4411 C→G Yes 4414 G→A Yes 4535 G→T Yes 4628 A→T Yes 4847 A→G No 4939 T→C Yes 5073 G→No 5489 C→G Yes 5700 G→C No 5743 G→A Yes 5753 A→C Yes 5928 A→C Yes 5934 G→A Yes 5999 A→C Yes Variant protein HSCOC4_PEA.sub.--1_P12 (SEQ ID NO:491) according to the present invention has an amino acid sequence as given at the end of the application; it is encoded by transcript(s) HSCOC4_PEA.sub.--1_T11 (SEQ ID NO:394). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P12 (SEQ ID NO:491) and CO4_HUMAN_V1 (SEQ ID NO:486):

1. An isolated chimeric polypeptide encoding for HSCOC4_PEA.sub.--1_P12 (SEQ ID NO:491), comprising a first amino acid sequence being at least 90% homologous to MRLLWGLIWASSFFTLSLQKPRLLLF-SPSVVHLGVPLSVGVQLQDVPRGQVVKGSVFLR NRSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIARLTVMPPSGGPGFLSIERPD SRPPRVGDTLNLNLRAVGSGATFSHY-YYMILSRGQIVFMNREPKRTLTSVSVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYMWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGNSKGTLKV corresponding to amino acids 1-1380 of CO4_HUMAN_V1 (SEQ ID NO:486), which also corresponds to amino acids 1-1380 of HSCOC4_PEA.sub.--1_P12 (SEQ ID NO:491), and a second amino acid sequence being at least 70%, optionally at least 80%, preferably at least 85%, more preferably at least 90% and most preferably at least 95% homologous to a polypeptide having the sequence RAREGVG-PGTGGGEGVE (SEQ ID NO:980) corresponding to amino acids 1381-1397 of HSCOC4_PEA.sub.--1_P12 (SEQ ID NO:491), wherein said first amino acid sequence and second amino acid sequence are contiguous and in a sequential order.

2. An isolated polypeptide encoding for a tail of HSCOC4_PEA.sub.--1_P12 (SEQ ID NO:491), comprising a polypeptide being at least 70%, optionally at least about 80%, preferably at least about 85%, more preferably at least about 90% and most preferably at least about 95% homologous to the sequence RAREGVGPGTGGGEGVE (SEQ ID NO:980) in HSCOC4_PEA.sub.--1_P12 (SEQ ID NO:491).

It should be noted that the known protein sequence (CO4_HUMAN (SEQ ID NO:485)) has one or more changes than the sequence given at the end of the application and named as being the amino acid sequence for CO4_HUMAN_V1 (SEQ ID NO:486). These changes were previously known to occur and are listed in the table below. TABLE-US-00706 TABLE 19 Changes to CO4_HUMAN_V1 (SEQ ID NO: 486) SNP position(s) on amino acid sequence Type of change 1177 variant 1202 variant 1208 variant 1211 variant 1287 variant The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P12 (SEQ ID NO:491) also has the following non-silent SNPs (Single Nucleotide Polymorphisms) as listed in Table 20, (given according to their position(s) on the amino acid sequence, with the alternative amino acid(s) listed; the last column indicates whether the SNP is known or not; the presence of known SNPs in variant protein HSCOC4_PEA.sub.--1_P12 (SEQ ID NO:491) sequence provides support for the deduced sequence of this variant protein according to the present invention). TABLE-US-00707 TABLE 20 Amino acid mutations SNP position(s) on amino Alternative amino acid sequence acid(s) Previously known SNP? 128 Q→No 141 L→V Yes 183 G→No 211 G→No 322 A→No 322 A→V No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207 A→V Yes 1210 R→L Yes 1286 A→S Yes 1317 I→F Yes Variant protein HSCOC4_PEA.sub.--1_P12 (SEQ ID NO:491) is encoded by the following transcript(s): HSCOC4_PEA.sub.--1_T11 (SEQ ID NO:394), for which the sequence(s) is/are given at the end of the application. The coding portion of transcript HSCOC4_PEA.sub.--1_T11 (SEQ ID NO:394) is shown in bold; this coding portion starts at position 501 and ends at position 4691. The transcript also has the following SNPs as listed in Table 21 (given according to their position on the nucleotide sequence, with the alternative nucleic acid listed; the last column indicates whether the SNP is known or not; the presence of known SNPs in variant protein HSCOC4_PEA.sub.--1_P12 (SEQ ID NO:491) sequence provides support for the deduced sequence of this variant protein according to the present invention). TABLE-US-00708 TABLE 21 Nucleic acid SNPs SNP position on nucleotide Alternative sequence nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4226 G→A Yes 4232 C→G Yes 4235 G→A Yes 4356 G→T Yes 4449 A→T Yes 4859 C→T Yes 4876 C→A Yes 4882 C→G Yes 4924 G→A Yes 5205 C→G Yes 5596 C→T Yes 5717 A→G No 5809 T→C Yes 5943 G→No 6359 C→G Yes 6570 G→C No 6613 G→A Yes 6623 A→C Yes 6798 A→C Yes 6804 G→A Yes 6869 A→C Yes Variant protein HSCOC4_PEA.sub.--1_P15 (SEQ ID NO:492) according to the present invention has an amino acid sequence as given at the end of the application; it is encoded by transcript(s) HSCOC4_PEA.sub.--1_T14 (SEQ ID NO:396). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P15 (SEQ ID NO:492) and CO4_HUMAN_V1 (SEQ ID NO:486):

1. An isolated chimeric polypeptide encoding for HSCOC4_PEA.sub.--1_P15 (SEQ ID NO:492), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIARLTVMPPSGGPGFLSIERPD SRPPRVGDTLNLNLRAVGSGATFSHY-YYMILSRGQIVFMNREPKRTLTSVSVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRMRVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLMSRYLDKTE-QWSTLPPETKDHAVDLIQKGYMRIQQFRK ADGSYM-WLSRDSSTWLTAFVLKVLSLAQEQVGGS-PEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQ corresponding to amino acids 1-1359 of CO4_HUMAN_V1 (SEQ ID NO:486), which also corresponds to amino acids 1-1359 of HSCOC4_PEA.sub.--1_P15 (SEQ ID NO:492), and a second amino acid sequence being at least 70%, optionally at least 80%, preferably at least 85%, more preferably at least 90% and most preferably at least 95% homologous to a polypeptide having the sequence VNH-SLVNHSLAWVARTPGPRGQARSRPQPP-TRGIPMLLPGVFGGRLTSWLRDLEL (SEQ ID NO:981) corresponding to amino acids 1360-1415 of HSCOC4_PEA.sub.--1_P15 (SEQ ID NO:492, wherein said first amino acid sequence and second amino acid sequence are contiguous and in a sequential order.

2. An isolated polypeptide encoding for a tail of HSCOC4_PEA.sub.--1_P15 (SEQ ID NO:492), comprising a polypeptide being at least 70%, optionally at least about 80%, preferably at least about 85%, more preferably at least about 90% and most preferably at least about 95% homologous to the sequence VNHSLVNHSLAWWVARTPG-PRGQARSRPQPPTRGIPPMLLPGVFGGR-LTSWLRDLEL (SEQ ID NO:981) in HSCOC4_PEA.sub.--1_P15 (SEQ ID NO:492).

It should be noted that the known protein sequence (CO4_HUMAN (SEQ ID NO:485)) has one or more changes than the sequence given at the end of the application and named as being the amino acid sequence for CO4_HUMAN_V1 (SEQ ID NO:486). These changes were previously known to occur and are listed in the table below. TABLE-US-00709 TABLE 22 Changes to CO4_HUMAN_V1 (SEQ ID NO: 486) SNP position(s) on amino acid sequence Type of change 1177 variant 1202 variant 1208 variant 1211 variant 1287 variant The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P15 (SEQ ID NO:492) also has the following non-silent SNPs (Single Nucleotide Polymorphisms) as listed in Table 23, (given according to their position(s) on the amino acid sequence, with the alternative amino acid(s) listed; the last column indicates whether the SNP is known or not; the presence of known SNPs in variant protein HSCOC4_PEA.sub.--1_P15 (SEQ ID NO:492) sequence provides support for the deduced sequence of this variant protein according to the present invention). TABLE-US-00710 TABLE 23 Amino acid mutations SNP position(s) on amino acid Alternative sequence amino acid(s) Previously known SNP? 128 Q→No 141 L→V Yes 183 G→No 211 G→No 322 A→V No 322 A→No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207 A→V Yes 1210 R→L Yes 1286 A→S Yes 1317 I→F Yes 1387 Q→H Yes 1411 R→C Yes Variant protein HSCOC4_PEA.sub.--1_P15 (SEQ ID NO:492) is encoded by the following transcript(s): HSCOC4_PEA.sub.--1_T14 (SEQ ID NO:396), for which the sequence(s) is/are given at the end of the application. The coding portion of transcript HSCOC4_PEA.sub.--1_T14 (SEQ ID NO:396) is shown in bold; this coding portion starts at position 501 and ends at position 4745. The transcript also has the following SNPs as listed in Table 24 (given according to their position on the nucleotide sequence, with the alternative nucleic acid listed; the last column indicates whether the SNP is known or not; the presence of known SNPs in variant protein HSCOC4_PEA.sub.--1_P15 (SEQ ID NO:492) sequence provides support for the deduced sequence of this variant protein according to the present invention). TABLE-US-00711 TABLE 24 Nucleic acid SNPs SNP position on nucleotide Alternative sequence nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4226 G→A Yes 4232 C→G Yes 4235 G→A Yes 4356 G→T Yes 4449 A→T Yes 4661 A→C Yes 4731 C→T Yes 4872 A→G Yes 4905 C→T Yes 5061 A→G No 5153 T→C Yes 5287 G→No 5703 C→G Yes 5914 G→C No 5957 G→A Yes 5967 A→C Yes 6142 A→C Yes 6148 G→A Yes 6213 A→C Yes Variant protein HSCOC4_PEA.sub.--1_P16 (SEQ ID NO:493) according to the present invention has an amino acid sequence as given at the end of the application; it is encoded by transcript(s) HSCOC4_PEA.sub.--1_T15 (SEQ ID NO:397). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P16 (SEQ ID NO:493) and CO4_HUMAN_V1 (SEQ ID NO:486):

1. An isolated chimeric polypeptide encoding for HSCOC4_PEA.sub.--1_P16 (SEQ ID NO:493), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDTI TVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYMWLSRDSSTWLTAFVLKV- LSLAQEQVGGSPEKLQETSNWLLSQQQADGSFQ
DPCPVLDRSMQGGLVGNDETVALTAFV-
TIALHHGLAVFQDEGAEPLKQRVEASISKASS
FLGEKASAGLLGAHAAAITAYALTLTKA-
PADLRGVAHNNLMAMAQETGDNLYWGSV TGSQS-
NAVSPTPAPRNPSDPMPQAPALWIET-
TAYALLHLLLHEGKAEMADQAMWLTR
QGSFQGGFRSTQDTVIALDALSAY-
WIASHTTEERGLNVTLSSTGRNGFKSHALQLNNRQ
IRGLEEELQFSLGSKINVKVGGN-
SKGTLKVLRTYNVLDMKNTTCQDLQIEVTVKGHVE
YTMEANEDYEDYEYDELPAKDDPDA-
PLQPVTPLQLFEGRRNRRRREAPK corresponding to amino acids 1-1457 of CO4_HUMAN_V1 (SEQ ID NO:486), which also corresponds to amino acids 1-1457 of HSCOC4_PEA.sub.--1_P16 (SEQ ID NO:493), and a second amino acid sequence being at least 70%, optionally at least 80%, preferably at least 85%, more preferably at least 90% and most preferably at least 95% homologous to a polypeptide having the sequence AERQGGAVWHGHR-GRHPPEWIPRPAC (SEQ ID NO:982) corresponding to amino acids 1458-1483 of HSCOC4_PEA.sub.--1_P16 (SEQ ID NO:493), wherein said first amino acid sequence and second amino acid sequence are contiguous and in a sequential order.

2. An isolated polypeptide encoding for a tail of HSCOC4_PEA.sub.--1_P16 (SEQ ID NO:493), comprising a polypeptide being at least 70%, optionally at least about 80%, preferably at least about 85%, more preferably at least about 90% and most preferably at least about 95% homologous to the sequence AERQGGAVWHGHR-GRHPPEWIPRPAC (SEQ ID NO:982) in HSCOC4_PEA.sub.--1_P16 (SEQ ID NO:493).

It should be noted that the known protein sequence (CO4_HUMAN (SEQ ID NO:485)) has one or more changes than the sequence given at the end of the application and named as being the amino acid sequence for CO4_HUMAN_V1 (SEQ ID NO:486). These changes were previously known to occur and are listed in the table below. TABLE-US-00712 TABLE 25 Changes to CO4_HUMAN_V1 (SEQ ID NO: 486) SNP position(s) on amino acid sequence Type of change 1177 variant 1202 variant 1208 variant 1211 variant 1287 variant The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HSCOC4_PEA.sub.--1_P16 (SEQ ID NO:493) also has the following non-silent SNPs (Single Nucleotide Polymorphisms) as listed in Table 26, (given according to their position(s) on the amino acid sequence, with the alternative amino acid(s) listed; the last column indicates whether the SNP is known or not; the presence of known SNPs in variant protein HSCOC4_PEA.sub.--1_P16 (SEQ ID NO:493) sequence provides support for the deduced sequence of this variant protein according to the present invention). TABLE-US-00713 TABLE 26 Amino acid mutations SNP position(s) on amino acid Alternative sequence amino acid(s) Previously known SNP? 128 Q→No 141 L→V Yes 183 G→No 211 G→No 322 A→No 322 A→V No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207 A→V Yes 1210 R→L Yes 1286 A→S Yes 1317 I→F Yes 1390 K→E No Variant protein HSCOC4_PEA.sub.--1_P16 (SEQ ID NO:493) is encoded by the following transcript(s): HSCOC4_PEA.sub.--1_T15 (SEQ ID NO:397), for which the sequence(s) is/are given at the end of the application. The coding portion of transcript HSCOC4_PEA.sub.--1_T15 (SEQ ID NO:397) is shown in bold; this coding portion starts at position 501 and ends at position 4949. The transcript also has the following SNPs as listed in Table 27 (given according to their position on the nucleotide sequence, with the alternative nucleic acid listed; the last column indicates whether the SNP is known or not; the presence of known SNPs in variant protein HSCOC4_PEA_I_P16 (SEQ ID NO:493) sequence provides support for the deduced sequence of this variant protein according to the present invention). TABLE-US-00714 TABLE 27 Nucleic acid SNPs SNP position on nucleotide Alternative sequence nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4226 G→A Yes 4232 C→G Yes 4235 G→A Yes 4356 G→T Yes 4449 A→T Yes 4668 A→G No 4760 T→C Yes 5263 C→G Yes 5474 G→C No 5517 G→A Yes 5527 A→C Yes 5702 A→C Yes 5708 G→A Yes 5773 A→C Yes Variant protein HSCOC4_PEA.sub.--1_P20 (SEQ ID NO:494) according to the present invention has an amino acid sequence as given at the end of the application; it is encoded by transcript(s) HSCOC4_PEA.sub.--1_T20 (SEQ ID NO:398). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P20 (SEQ ID NO:494) and CO4_HUMAN_V1 (SEQ ID NO:486):

1. An isolated chimeric polypeptide encoding for HSCOC4_PEA.sub.--1_P20 (SEQ ID NO:494), comprising a first amino acid sequence being at least 90% homologous to MRLLWGLIWASSFFTLSLQKPRLLLF-
SPSVVHLGVPLSVGVQLQDVPRGQVVKGSVFLR
NPSRNNVPCSPKVDFTLSSERD-
FALLSLQVPLKDAKSCGLHQLLRGPE-
VQLVAHSPWLK DSLSRTTNIQGINLLFSSR-
RGHLFLQTDQPIYNPGQRVRYRVFALDQKMRPSTDT
ITVMV ENSHGLRVRKKEVYMPSSIFQDDFVIP-
DISEPGTWKISARFSDGLESNSSTQFEVKKYVL PNFE-
VKITPGKPYILTVPGHLDEMQLDIQARY-
IYGKPVQGVAYVRFGLLDEDGKKTFFR
GLESQTKLVNGQSHISLSKAEFQDALEK-
LNMGITDLQGLRLYVAAAIIESPGGEMEEAE LTSWY-
FVSSPFSLDLSKTKRHLVPGAP-
FLLQALVREMSGSPASGIPVKVSATVSSPGSVP
EVQDIQQNTDGSGQVSIPIIIPQ-
TISELQLSVSAGSPHPAIARLTVMPPSGGPGFLSIERPD SRPPRVGDTLNLNLRAVGSGATFSHY-
YYMILSRGQIVFMNREPKRTLTSVSVFVDHHLA
PSFYFVAFYYHGDHPVANSLRVDVQA-
GACEGKLELSVDGAKQYRNGESVKLHLETDS LAL-
VALGALDTALYMGSKSHKPLN-
MGKVFEAMNSYDLGCGPGGGDSALQVFQAAG
LAFSDGDQWTLSRKRLSCPKEKT-
TRKKRNVNFQKAINEKLGQYASPTAKRCCQDGVTR
LPMMRSCEQRAARVQQPDCREPFLSCCQ-
FAESLRKKSRDKGQAGLQRALEILQEEDLID
EDDIPVRSFFPENWLWRVETVDRF-
QILTLWLPDSLTTWEIHGLSLSKTKGLCVATPVQL
RVFREFHLHLRLPMSVRRFEQLELRPV-
LYNYLDKNLTVSVHVSPVEGLCLAGGGGLAQ
QVLVPAGSARPVAFSVVPTAAAAVSLKV-
VARGSFEFPVGDAVSKVLQIEKEGAIHREEL VYELN-
PLDHRGRTLEIPGNSDPNMIPDGDFN-
SYVRVTASDPLDTLGSEGALSPGGVASL
LRLPRGCGEQTMIYLAPTLAASRYLDK-
TEQWSTLPPETKDHAVDLIQKGYMRIQQFRK
ADGSYMWLSRDSSTWLTAFVLKV-
LSLAQEQVGGSPEKLQETSNWLLSQQQADGSFQ
DPCPVLDRSMQGGLVGNDETVALTAFV-
TIALHHGLAVFQDEGAEPLKQRVEASISKASS
FLGEKASAGLLGAHAAAITAYALTLTKA-
PADLRGVAHNNLMAMAQETGDNLYWGSV TGSQS-
NAVSPTPAPRNPSDPMPQAPALWIET-
TAYALLHLLLHEGKAEMADQAAAWLTR
QGSFQGGFRSTQ corresponding to amino acids 1-1303 of CO4_HUMAN_V1 (SEQ ID NO:486), which also corresponds to amino acids 1-1303 of HSCOC4_PEA.sub.--1_P20 (SEQ ID NO:494), and a second amino acid sequence being at least 70%, optionally at least 80%, preferably at least 85%, more preferably at least 90% and most preferably at least 95% homologous to a polypeptide having the sequence VGAVPGLWRGWWLRPRACLSPGSTSLGH-
GDCPGCPVCLLDCLPHH (SEO ID NO:983) corresponding to amino acids 1304-1349 of HSCOC4_PEA.sub.--1_P20 (SEO ID NO:494), wherein said first amino acid sequence and second amino acid sequence are contiguous and in a sequential order.

2. An isolated polypeptide encoding for a tail of HSCOC4_PEA.sub.--1_P20 (SEQ ID NO:494), comprising a polypeptide being at least 70%, optionally at least about 80%, preferably at least about 85%, more preferably at least about 90% and most preferably at least about 95% homologous to the sequence TABLE-US-00715 (SEQ ID NO:983) VGAVPGLWRGWWLRPRACLSPGSTSLGH-
GDCPGCPVCLLDCLPHH in HSCOC4_PEA_1_P20 (SEQ ID NO:494).

It should be noted that the known protein sequence (CO4_HUMAN (SEQ ID NO:485)) has one or more changes than the sequence given at the end of the application and named as being the amino acid sequence for CO4_HUMAN_V1 (SEQ ID NO:486). These changes were previously known to occur and are listed in the table below. TABLE-US-00716 TABLE 28 Changes to CO4_HUMAN_V1 (SEQ ID NO: 486) SNP position(s) on amino acid sequence Type of change 1177 variant 1202 variant 1208 variant 1211 variant 1287 variant The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P20 (SEQ ID NO:494) also has the following non-silent SNPs (Single Nucleotide Polymorphisms) as listed in Table 29, (given according to their position(s) on the amino acid sequence, with the alternative amino acid(s) listed; the last column indicates whether the SNP is known or not; the presence of known SNPs in variant protein HSCOC4_PEA.sub.--1_P20 (SEQ ID NO:494) sequence provides support for the deduced sequence of this variant protein according to the present invention). TABLE-US-00717 TABLE 29 Amino acid mutations SNP position(s) on amino acid Alternative sequence amino acid(s) Previously known SNP? 128 Q→No 141 L→V Yes 183 G→No 211 G→No 322 A→No 322 A→V No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207 A→V Yes 1210 R→L Yes 1286 A→S Yes 1312 R→G Yes 1344 D→V Yes Variant protein HSCOC4_PEA.sub.--1_P20 (SEQ ID NO:494) is encoded by the following transcript(s): HSCOC4_PEA.sub.--1_T20 (SEQ ID NO:398), for which the sequence(s) is/are given at the end of the application. The coding portion of transcript HSCOC4_PEA.sub.--1_T20 (SEQ ID NO:398) is shown in bold; this coding portion starts at position 501 and ends at position 4547. The transcript also has the following SNPs as listed in Table 30 (given according to their position on the nucleotide sequence, with the alternative nucleic acid listed; the last column indicates whether the SNP is known or not; the presence of known SNPs in variant protein HSCOC4_PEA.sub.--1_P20 (SEQ ID NO:494) sequence provides support for the deduced sequence of this variant protein according to the present invention). TABLE-US-00718 TABLE 30 Nucleic acid SNPs SNP position on nucleotide Alternative sequence nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4226 G→A Yes 4232 C→G Yes 4235 G→A Yes 4356 G→T Yes 4434 C→G Yes 4531 A→T Yes 4743 A→C Yes 4813 C→T Yes 4954 A→G Yes 4987 C→T Yes 5143 A→G No 5235 T→C Yes 5369 G→No 5785 C→G Yes 5996 G→C No 6039 G→A Yes 6049 A→C Yes 6224 A→C Yes 6230 G→A Yes 6295 A→C Yes Variant protein HSCOC4_PEA.sub.--1_P9 (SEQ ID NO:495) according to the present invention has an amino acid sequence as given at the end of the application; it is encoded by transcript(s) HSCOC4_PEA.sub.--1_T21 (SEQ ID NO:399). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to, the present invention to each such aligned protein is as follows:

Comparison report between HSCOC4_PEA.sub.--1_P9 (SEQ ID NO:495) and CO4_HUMAN_V1 (SEQ ID NO:486):

1. An isolated chimeric polypeptide encoding for HSCOC4_PEA.sub.--1_P9 (SEQ ID NO:495), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLMSRYLDKTE-QWSTLPPETKDHAVDLIQKGYMRIQQFRK ADGSYM-WLSRDSSTWLTAFVLKVLSLAQEQVGGS-PEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKWEEQESRV HYTVCIWRNGKVGLSGMAIADVTLLSGF-HALRADLEKLTSLSDRYVSHFETEGPHVLL YFDSV corresponding to amino acids 1-1529 of CO4_HUMAN_V1 (SEQ ID NO:486), which also corresponds to amino acids 1-1529 of HSCOC4_PEA.sub.--1_P9 (SEQ ID NO:495), and a second amino acid sequence being at least 70%, optionally at least 80%, preferably at least 85%, more preferably at least 90% and most preferably at least 95% homologous to a polypeptide having the sequence SGER (SEQ ID NO:984) corresponding to amino acids 1530-1533 of HSCOC4_PEA.sub.--1_P9 (SEQ ID NO:495), wherein said first amino acid sequence and second amino acid sequence are contiguous and in a sequential order.

2. An isolated polypeptide encoding for a tail of HSCOC4_PEA.sub.--1_P9 (SEQ ID NO:495), comprising a polypeptide being at least 70%, optionally at least about 80%, preferably at least about 85%, more preferably at least about 90% and most preferably at least about 95% homologous to the sequence SGER (SEQ ID NO:984) in HSCOC4_PEA.sub.--1_P9 (SEQ ID NO:495).

It should be noted that the known protein sequence (CO4_HUMAN (SEQ ID NO:485)) has one or more changes than the sequence given at the end of the application and named as being the amino acid sequence for CO4_HUMAN_V1 (SEQ ID NO:486). These changes were previously known to occur and are listed in the table below. TABLE-US-00719 TABLE 31 Changes to CO4_HUMAN_V1 (SEQ ID NO: 486) SNP position(s) on amino acid sequence Type of change 1177 variant 1202 variant 1208 variant 1211 variant 1287 variant The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P9 (SEQ ID NO:495) also has the following non-silent SNPs (Single Nucleotide Polymorphisms) as listed in Table 32, (given according to their position(s) on the amino acid sequence, with the alternative amino acid(s) listed; the last column indicates whether the SNP is known or not; the presence of known SNPs in variant protein HSCOC4_PEA.sub.--1_P9 (SEQ ID NO:495) sequence provides support for the deduced sequence of this variant protein according to the present invention). TABLE-US-00720 TABLE 32 Amino acid mutations SNP position(s) on amino acid Alternative sequence amino acid(s) Previously known SNP? 128 Q→No 141 L→V Yes 183 G→No 211 G→No 322 A→V No 322 A→No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207 A→V Yes 1210 R→L Yes 1286A→S Yes 1317 I→F Yes 1390 K→E No 1465 R→No Variant protein HSCOC4_PEA.sub.--1_P9 (SEQ ID NO:495) is encoded by the following transcript(s): HSCOC4_PEA1_T21 (SEQ ID NO:399), for which the sequence(s) is/are given at the end of the application. The coding portion of transcript HSCOC4_PEA.sub.--1_T21 (SEQ ID NO:399) is shown in bold; this coding portion starts at position 501 and ends at position 5099. The transcript also has the following SNPs as listed in Table 33 (given according to their position on the nucleotide sequence, with the alternative nucleic acid listed; the last column indicates whether the SNP is known or not; the presence of known SNPs in variant protein HSCOC4_PEA.sub.--1_P9 (SEQ ID NO:495) sequence provides support for the deduced sequence of this variant protein according to the present invention). TABLE-US-00721 TABLE 33 Nucleic acid SNPs SNP position on nucleotide Alternative sequence nucleic acid Previously known SNP? 304A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4226 G→A Yes 4232 C→G Yes 4235 G→A Yes 4356 G→T Yes 4449 A→T Yes 4668 A→G No 4760 T→C Yes 4894 G→No 5561 G→A Yes 6026 T→G Yes 6348 G→C Yes 6966 C→G Yes 7177 G→C No 7220 G→A Yes 7230 A→C Yes 7405 A→C Yes 7411 G→A Yes 7476 A→C Yes Variant protein HSCOC4_PEA.sub.--1_P22 (SEQ ID NO:496) according to the present invention has an amino acid sequence as given at the end of the application; it is encoded by transcript(s) HSCOC4_PEA.sub.--1_T25 (SEQ ID NO:400). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P22 (SEQ ID NO:496) and CO4_HUMAN_V1 (SEQ ID NO:486):

1. An isolated chimeric polypeptide encoding for HSCOC4_PEA.sub.--1_P22 (SEQ ID NO:496), comprising a first amino acid sequence being at least 90% homologous to MRLLWGLIWASSFFTLSLQKPRLLLF-SPSVVHLGVPLSVGVQLQDVPRGQCVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDTI TVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIARLTVMPPSGGPGFLSIERPD SRPPRRVGDTLNLNLRAVGSGATFSHY-YYMILSRGQIVFMNREPKRTLTSVSVFVDHHLA PSFYFVAFYYHGDHPVANSLRVDVQA-GACEGKLELSVDGAKQYRNGESVKLHLETDS LASLVALGALDTALYMGSKSHKPLN-MGKVFEAMNSYDLGCGPGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLMSRYLDKTE-QWSTLPPETKDHAVDLIQKGYMRIQQFRK ADGSYM-WLSRDSSTWLTAFVLKVLSLAQEQVGGS-PEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKVVEEQESRV HYTVCIWRNGKVGLSGMAIADVTLLSGF-HALRADLEKLTSLSDRYVSHFETEGPHVLL YFDS-VPTSRECVGFEAVQEVPVGLVQPASAT-LYDYYNPERRCSVFYGAPSKSRLLATLC SAEVCQCAEGKCPRQRRALERGLQD-EDGYRMKFACYYPRVEYGFQVKVLREDSRAAF RLFETKITQVLHF corresponding to amino acids 1-1653 of CO4_HUMAN_V1 (SEQ ID NO:486), which also corresponds to amino acids 1-1653 of HSCOC4_PEA.sub.--1_P22 (SEQ ID NO:496), and a second amino acid sequence being at least 70%, optionally at least 80%, preferably at least 85%, more preferably at least 90% and most preferably at least 95% homologous to a polypeptide having the sequence SMKQT-GEAGRAGGRQGG (SEQ ID NO:985) corresponding to amino acids 1654-1670 of HSCOC4_PEA.sub.--1_P22 (SEQ ID NO:496), wherein said first amino acid sequence and second amino acid sequence are contiguous and in a sequential order.

2. An isolated polypeptide encoding for a tail of HSCOC4_PEA.sub.--1_P22 (SEQ ID NO:496), comprising a polypeptide being at least 70%, optionally at least about 80%, preferably at least about 85%, more preferably at least about 90% and most preferably at least about 95% homologous to the sequence SMKQTGEAGRAGGRQGG (SEQ ID NO:985) in HSCOC4_PEA.sub.--1_P22 (SEQ ID NO:496).

It should be noted that the known protein sequence (CO4_HUMAN (SEQ ID NO:485)) has one or more changes than the sequence given at the end of the application and named as being the amino acid sequence for CO4_HUMAN_V1 (SEQ ID NO:486). These changes were previously known to occur and are listed in the table below. TABLE-US-00722 TABLE 34 Changes to CO4_HUMAN_V1 (SEQ ID NO: 486) SNP position(s) on amino acid sequence Type of change 1177 variant 1202 variant 1208 variant 1211 variant 1287 variant The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P22 (SEQ ID NO:496) also has the following non-silent SNPs (Single Nucleotide Polymorphisms) as listed in Table 35, (given according to their position(s) on the amino acid sequence, with the alternative amino acid(s) listed; the last column indicates whether the SNP is known or not; the presence of known SNPs in variant protein HSCOC4_PEA.sub.--1_P22 (SEQ ID NO:496) sequence provides support for the deduced sequence of this variant protein according to the present invention).

TABLE-US-00723 TABLE 35 Amino acid mutations SNP position(s) on amino acid Alternative sequence amino acid(s) Previously known SNP? 128 Q→No 141 L→V Yes 183 G→No 211 G→No 322 A→No 322 A→V No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207 A→V Yes 1210 R→L Yes 1286 A→S Yes 1317 I→F Yes 1390 K→E No 1465 R→No 1604 R→G Yes Variant protein HSCOC4_PEA.sub.--1_P22 (SEQ ID NO:496) is encoded by the following transcript(s): HSCOC4_PEA.sub.--1_T25 (SEQ ID NO:400), for which the sequence(s) is/are given at the end of the application. The coding portion of transcript HSCOC4_PEA.sub.--1_T25 (SEQ ID NO:400) is shown in bold; this coding portion starts at position 501 and ends at position 5510. The transcript also has the following SNPs as listed in Table 36 (given according to their position on the nucleotide sequence, with the alternative nucleic acid listed; the last column indicates whether the SNP is known or not; the presence of known SNPs in variant protein HSCOC4_PEA.sub.--1_P22 (SEQ ID NO:496) sequence provides support for the deduced sequence of this variant protein according to the present invention).

TABLE-US-00724 TABLE 36 Nucleic acid SNPs SNP position on nucleotide Alternative sequence nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4226 G→A Yes 4232 C→G Yes 4235 G→A Yes 4356 G→T Yes 4449 A→T Yes 4668 A→G No 4760 T→C Yes 4894 G→No 5310 C→G Yes 5783 G→C No 5826 G→A Yes 5836 A→C Yes 5974 C→T Yes 5981 C→T Yes 6154 A→C Yes 6160 G→A Yes 6225 A→C Yes 6283 C→T Yes 6548 C→T Yes 6567 C→T Yes 7300 C→A Yes 7520 C→T Yes 7685 A→C Yes Variant protein HSCOC4_PEA.sub.--1_P23 (SEQ ID NO:497) according to the present invention has an amino acid sequence as given at the end of the application; it is encoded by transcript(s) HSCOC4_PEA.sub.--1_T28 (SEQ ID NO:401). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P23 (SEQ ID NO:497) and CO4_HUMAN_V1 (SEQ ID NO:486):

1. An isolated chimeric polypeptide encoding for HSCOC4_PEA.sub.--1_P23 (SEQ ID NO:497), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIARLTVMPPSGGPGFLSIERPD SRPPRVGDTLNLNLRAVGSGATFSHY-YYMILSRGQIVFMNREPKRTLTSVSVFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKANEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYMWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAMITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRREAPKWEEQESRV HYTVCIWRNGKVGLSGMAIADVTLLSGF-HALRADLEKLTSLSDRYVSHFETEGPHVLL YFDS-VPTSRECVGFEAVQEVPVGLVQPASAT-LYDYYNPERRCSVFYGAPSKSRLLATLC SAEVCQCAEGKCPRQRRALERGLQD-EDGYRMKFACYYPRVEYG corresponding to amino acids 1-1626 of CO4_HUMAN_V1 (SEQ ID NO:486), which also corresponds to amino acids 1-1626 of HSCOC4_PEA.sub.--1_P23 (SEQ ID NO:497), and a second amino acid sequence being at least 70%, optionally at least 80%, preferably at least 85%, more preferably at least 90% and most preferably at least 95% homologous to a polypeptide having the sequence QSSHRGPGLTLPRGPAVLVSLGVAC-SSYRSCTQPVCSDTNFLPSQPQSNSPFPLLLTPS (SEQ ID NO:986) corresponding to amino acids 1627-1685 of HSCOC4_PEA.sub.--1_P23 (SEQ ID NO:497), wherein said first amino acid sequence and second amino acid sequence are contiguous and in a sequential order.

2. An isolated polypeptide encoding for a tail of HSCOC4_PEA.sub.--1_P23 (SEQ ID NO:497), comprising a polypeptide being at least 70%, optionally at least about 80%, preferably at least about 85%, more preferably at least about 90% and most preferably at least about 95% homologous to the sequence TABLE-US-00725 (SEQ ID NO:986)

QSSHRGPGLTLPRGPAVLVSLGVAC-SSYRSCTQPVCSDTNFLPSQPQSNS PFPLLLTPS in HSCOC4_PEA_1_P23 (SEQ ID NO:497).

It should be noted that the known protein sequence (CO4_HUMAN (SEQ ID NO:485)) has one or more changes than the sequence given at the end of the application and named as being the amino acid sequence for CO4_HUMAN_V1 (SEQ ID NO:486). These changes were previously known to occur and are listed in the table below. TABLE-US-00726 TABLE 37 Changes to CO4_HUMAN_V1 (SEQ ID NO: 486) SNP position(s) on amino acid sequence Type of change 1177 variant 1202 variant 1208 variant 1211 variant 1287 variant The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HSCOC4_PEA.sub.--1_P23 (SEQ ID NO:497) also has the following non-silent SNPs (Single Nucleotide Polymorphisms) as listed in Table 38, (given according to their position(s) on the amino acid sequence, with the alternative amino acid(s) listed; the last column indicates whether the SNP is known or not; the presence of known SNPs in variant protein HSCOC4_PEA.sub.--1_P23 (SEQ ID NO:497) sequence provides support for the deduced sequence of this variant protein according to the present invention). TABLE-US-00727 TABLE 38 Amino acid mutations SNP position(s) on amino acid sequence Alternative amino acid(s) Previously known SNP? 128 Q→No 141 L→V Yes 183 G→No 211 G→No 322 A→V No 322 A→No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207 A→V Yes 1210 R→L Yes 1286A→S Yes 1317 I→F Yes 1390 K→E No 1465 R→No 1604 R→G Yes 1634 G→Yes Variant protein HSCOC4_PEA.sub.--1_P23 (SEQ ID NO:497) is encoded by the following transcript(s): HSCOC4_PEA.sub.--1_T28 (SEQ ID NO:401), for which the sequence(s) is/are given at the end of the application. The coding portion of transcript HSCOC4_PEA.sub.--1_T28 (SEQ ID NO:401) is shown in bold; this coding portion starts at position 501 and ends at position 5555. The transcript also has the following SNPs as listed in Table 39 (given according to their position on the nucleotide sequence, with the alternative nucleic acid listed; the last column indicates whether the SNP is known or not; the presence of known SNPs in variant protein HSCOC4_PEA.sub.--1_P23 (SEQ ID NO:497) sequence provides support for the deduced sequence of this variant protein according to the present invention). TABLE-US-00728 TABLE 39 Nucleic acid SNPs SNP position on nucleotide sequence Alternative nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4226 G→A Yes 4232 C→G Yes 4235 G→A Yes 4356 G→T Yes 4449 A→T Yes 4668 A→G No 4760 T→C Yes 4894G→No 5310 C→G Yes 5402 C→Yes 5426 T→C Yes 5965 G→C No 6008 G→A Yes 6018 A→C Yes 6156 C→T Yes 6163 C→T Yes 6336 A→C Yes 6342 G→A Yes 6407 A→C Yes 6465 C→T Yes 6730 C→T Yes 6749 C →T Yes 7482 C→A Yes 7702 C→T Yes 7867 A→C Yes Variant protein HSCOC4_PEA.sub.--1_P24 (SEQ ID NO:498) according to the present invention has an amino acid sequence as given at the end of the application; it is encoded by transcript(s) HSCOC4_PEA.sub.--1_T30 (SEQ ID NO:402). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P24 (SEQ ID NO:498) and CO4_HUMAN_V1 (SEQ ID NO:486):

1. An isolated chimeric polypeptide encoding for HSCOC4_PEA.sub.--1_P24 (SEQ ID NO:498), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIARLTVMPPSGGPGFLSIERPD SRPPRVGDTLNLNLRAVGSGATFSHY-YYMILSRGQIVFMNREPKRTLTSVSVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLMSRYLDKTE-QWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET- TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKWEEQESRV HYTVCIWRNGKVGLSGMAIADVTLLSGF-HALRADLEKLTSLSDRYVSHFETEGPHVLL YFDS corresponding to amino acids 1-1528 of CO4_HUMAN_V1 (SEQ ID NO:486), which also corresponds to amino acids 1-1528 of HSCOC4_PEA.sub.--1_P24 (SEQ ID NO:498), and a second amino acid sequence being at least 70%, optionally at least 80%, preferably at least 85%, more preferably at least 90% and most preferably at least 95% homologous to a polypeptide having the sequence SADVLCFTGHQVRAD-SWPPCVLLKSASVLRGSALASVAPWSGVCRTRMATG (SEQ ID NO:987) corresponding to amino acids 1529-1579 of HSCOC4_PEA.sub.--1_P24 (SEQ ID NO:498), wherein said first amino acid sequence and second amino acid sequence are contiguous and in a sequential order.

2. An isolated polypeptide encoding for a tail of HSCOC4_PEA.sub.--1_P24 (SEQ ID NO:498), comprising a polypeptide being at least 70%, optionally at least about 80%, preferably at least about 85%, more preferably at least about 90% and most preferably at least about 95% homologous to the sequence TABLE-US-00729 (SEQ ID NO:987) SADVLCFTGHQVRADSWPPCVLLKSASV-LRGSALASVAPWSGVCRT RMATG in HSCOC4_PEA__1_P24 (SEQ ID NO:498).

It should be noted that the known protein sequence (CO4_HUMAN (SEQ ID NO:485)) has one or more changes than the sequence given at the end of the application and named as being the amino acid sequence for CO4_HUMAN_V1 (SEQ ID NO:486). These changes were previously known to occur and are listed in the table below. TABLE-US-00730 TABLE 40 Changes to CO4_HUMAN_V1 (SEQ ID NO: 486) SNP position(s) on amino acid sequence Type of change 1177 variant 1202 variant 1208 variant 1211 variant 1287 variant The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P24 (SEQ ID NO:498) also has the following non-silent SNPs (Single Nucleotide Polymorphisms) as listed in Table 41, (given according to their position(s) on the amino acid sequence, with the alternative amino acid(s) listed; the last column indicates whether the SNP is known or not; the presence of known SNPs in variant protein HSCOC4_PEA.sub.--1_P24 (SEQ ID NO:498) sequence provides support for the deduced sequence of this variant protein according to the present invention). TABLE-US-00731 TABLE 41 Amino acid mutations SNP position(s) on amino acid sequence Alternative amino acid(s) Previously known SNP? 128 Q→No 141 L→V Yes 183 G→No 211 G→No 322 A→No 322 A→V No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207 A→V Yes 1210 R→L Yes 1286 A→S Yes 1317 I→F Yes 1390 K→E No 1465 R→No 1569 S→R Yes Variant protein HSCOC4_PEA.sub.--1_P24 (SEQ ID NO:498) is encoded by the following transcript(s): HSCOC4_PEA.sub.--1_T30 (SEQ ID NO:402), for which the sequence(s) is/are given at the end of the application. The coding portion of transcript HSCOC4_PEA.sub.--1_T30 (SEQ ID NO:402) is shown in bold; this coding portion starts at position 501 and ends at position 5237. The transcript also has the following SNPs as listed in Table 42 (given according to their position on the nucleotide sequence, with the alternative nucleic acid listed; the last column indicates whether the SNP is known or not; the presence of known SNPs in variant protein HSCOC4_PEA.sub.--1_P24 (SEQ ID NO:498) sequence provides support for the deduced sequence of this variant protein according to the present invention). TABLE-US-00732 TABLE 42 Nucleic acid SNPs SNP position on nucleotide sequence Alternative nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4226 G→A Yes 4232 C→G Yes 4235 G→A Yes 4356 G→T Yes 4449 A→T Yes 4668 A→G No 4760 T→C Yes 4894 G→No 5207 C→G Yes 5418 G→C No 5461 G→A Yes 5471 A→C Yes 5646 A→C Yes 5652 G→A Yes 5717 A→C Yes Variant protein HSCOC4_PEA.sub.--1_P25 (SEQ ID NO:499) according to the present invention has an amino acid sequence as given at the end of the application; it is encoded by transcript(s) HSCOC4_PEA.sub.--1_T31 (SEQ ID NO:403). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P25 (SEQ ID NO:499) and CO4_HUMAN_V1 (SEQ ID NO:486):

1. An isolated chimeric polypeptide encoding for HSCOC4_PEA.sub.--1_P25 (SEQ ID NO:499), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIARLTVMPPSGGPGFLSIERPD SRPPRVGDTLNLNLRAVGSGATFSHY- YYMILSRGQIVFMNREPKRTLTSVSVFVDHHLAPSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAGLAFSDGDQWTLSRKRLSCPKEKT-TRKKRNVNFQKAINEKLGQYASPTAKRCCQDGVTRLPMMRSCEQRAARVQQPDCREPFLSCCQ-FAESLRKKSRDKGQAGLQRALEILQEEDLIDEDDIPVRSFFPENWLWRVETVDRF-QILTLWLPDSLTTWEIHGLSLSKTKGLCVATPVQLRVFREFHLHLRLPMSVRRFEQLELRPV-LYNYLDKNLTVSVHVSPVEGLCLAGGGGLAQQVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASLLRLPRGCGEQTMIYLAPTLAASRYLDK-TEQWSTLPPETKDHAVDLIQKGYMRIQQFRKADGSYMWLSRDSSTWLTAFVLKV-LSLAQEQVGGSPEKLQETSNWLLSQQQADGSFQDPCPVLDRSMQGGLVGNDETVALTAFV-TIALHHGLAVFQDEGAEPLKQRVEASISKASSFLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTRQGSFQGGFRSTQDTVIALDALSAY-WIASHTTEERGLNVTLSSTGRNGFKSHALQLNNRQIRGLEEELQFSLGSKINVKVGGN-SKGTLKVLRTYNVLDMKNTTCQDLQIEVTVKGHVEYTMEANEDYEDYEYDELPAKDDPDA-PLQPVTPLQLFEGRRNRRRREAPKWEEQESRVHYTVCIWRNGKVGLSGMAIADVTLLSGF-HALRADLEKLTSLSDRYVSHFETEGPHVLL YFDS-VPTSRECVGFEAVQEVPVGLVQPASAT-LYDYYNPERRCSVFYGAPSKSRLLATLCSAEVCQCAEG corresponding to amino acids 1-1593 of CO4_HUMAN_V1 (SEQ ID NO:486), which also corresponds to amino acids 1-1593 of HSCOC4_PEA.sub.--1_P25 (SEQ ID NO:499), and a second amino acid sequence being at least 70%, optionally at least 80%, preferably at least 85%, more preferably at least 90% and most preferably at least 95% homologous to a polypeptide having the sequence ETEGLGRGSGGGMAGAPPTLSDGFPN-FREVPSPASRPGAGSAGRGWLQDEVCLLLPPC GVR-LPG (SEQ ID NO:988) corresponding to amino acids 1594-1657 of HSCOC4_PEA.sub.--1_P25 (SEQ ID NO:499), wherein said first amino acid sequence and second amino acid sequence are contiguous and in a sequential order.

2. An isolated polypeptide encoding for a tail of HSCOC4_PEA.sub.--1_P25 (SEQ ID NO:499) comprising a polypeptide being at least 70%, optionally at least about 80%, preferably at least about 85%, more preferably at least about 90% and most preferably at least about 95% homologous to the sequence TABLE-US-00733 (SEQ ID NO:988) ETEGLGRGSGGGMAGAPPTLSDGFPN-FREVPSPASRPGAGSAGRGWLQDE VCLLLPPCGVR-LPG in HSCOC4_PEA__1_P25 (SEQ ID NO: 499).

It should be noted that the known protein sequence (CO4_HUMAN (SEQ ID NO:485)) has one or more changes than the sequence given at the end of the application and named as being the amino acid sequence for CO4_HUMAN_V1 (SEQ ID NO:486). These changes were previously known to occur and are listed in the table below. TABLE-US-00734 TABLE 43 Changes to CO4_HUMAN_V1 (SEQ ID NO: 486) SNP position(s) on amino acid sequence Type of change 1177 variant 1202 variant 1208 variant 1211 variant 1287 variant The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P25 (SEQ ID NO:499) also has the following non-silent SNPs (Single Nucleotide Polymorphisms) as listed in Table 44, (given according to their position(s) on the amino acid sequence, with the alternative amino acid(s) listed; the last column indicates whether the SNP is known or not; the presence of known SNPs in variant protein HSCOC4_PEA.sub.--1_P25 (SEQ ID NO:499) sequence provides support for the deduced sequence of this variant protein according to the present invention). TABLE-US-00735 TABLE 44 Amino acid mutations SNP position(s) on amino acid sequence Alternative amino acid(s) Previously known SNP? 128 Q→No 141 L→V Yes 183 G→No 211 G→No 322 A→No 322 A→V No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207 A→V Yes 1210 R→L Yes 1286 A→S Yes 1317 I→F Yes 1390 K→E No 1465 R→No 1632 A→G Yes Variant protein HSCOC4_PEA.sub.--1_P25 (SEQ ID NO:499) is encoded by the following transcript(s): HSCOC4_PEA.sub.--1_T31 (SEQ ID NO:403), for which the sequence(s) is/are given at the end of the application. The coding portion of transcript HSCOC4_PEA.sub.--1_T31 (SEQ ID NO:403) is shown in bold; this coding portion starts at position 501 and ends at position 5471. The transcript also has the following SNPs as listed in Table 45 (given according to their position on the nucleotide sequence, with the alternative nucleic acid listed; the last column indicates whether the SNP is known or not; the presence of known SNPs in variant protein HSCOC4_PEA.sub.--1_P25 (SEQ ID NO:499) sequence provides support for the deduced sequence of this variant protein according to the present invention). TABLE-US-00736 TABLE 45 Nucleic acid SNPs SNP position on nucleotide sequence Alternative nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4226 G→A Yes 4232 C→G Yes 4235 G→A Yes 4356 G→T Yes 4449 A→T Yes 4668 A→G No 4760 T→C Yes 4894 G→No 5395 C→G Yes 5606 G→C No 5649 G→A Yes 5659 A→C Yes 5834 A→C Yes 5840 G→A Yes 5905 A→C Yes Variant protein HSCOC4_PEA.sub.--1_P26 (SEQ ID NO:500) according to the present invention has an amino acid sequence as given at the end of the application; it is encoded by transcript(s) HSCOC4_PEA.sub.--1_T32 (SEQ ID NO:404). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P26 (SEQ ID NO:500) and CO4_HUMAN_V1 (SEQ ID NO:486):

1. An isolated chimeric polypeptide encoding for HSCOC4_PEA.sub.--1_P26 (SEQ ID NO:500), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIARLTVMPPSGGPGFLSIERPD SRPPRVGDTLNLNLRAVGSGATFSHY-YYMILSRGQIVFMNREPKRTLTSVSVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLMSRYLDKTE-QWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRRREAPKWEEQESRV HYTVCIWRNGKVGLSGMAIADVTLLSGF-HALRADLEKLTSLSDRYVSHFETEGPHVLL YFDS-VPTSRECVGFEAVQEVPVGLVQPASAT-LYDYYNPERRCSVFYGAPSKSRLLATLC SAEVCQCAEG corresponding to amino acids 1-1593 of CO4_HUMAN_V1 (SEQ ID NO:486), which also corresponds to amino acids 1-1593 of HSCOC4_PEA.sub.--1_P26 (SEQ ID NO:500), and a second amino acid sequence being at least 70%, optionally at least 80%, preferably at least 85%, more preferably at least 90% and most preferably at least 95% homologous to a polypeptide having the sequence TABLE-US-00737 (SEQ ID NO:989) ETEGLGRGSGGGMA-GAPPTLSDGFPNFREVPSPASRPGAGSAGRGWLQDE VCLLLPPCGVRSVFPPRPWPDPPSGT-GCFGLSGCSLLLLQVMHMCLL corresponding to amino acids 1594-1691 of HSCOC4_PEA.sub.--1_P26 (SEQ ID NO:500), wherein said first amino acid sequence and second amino acid sequence are contiguous and in a sequential order.

2. An isolated polypeptide encoding for a tail of HSCOC4_PEA.sub.--1_P26 (SEQ ID NO:500), comprising a polypeptide being at least 70%, optionally at least about 80%, preferably at least about 85%, more preferably at least about 90% and most preferably at least about 95% homologous to the sequence TABLE-US-00738 (SEQ ID NO:989) ETEGLGRGSGGGMAGAPPTLSDGFPN-FREVPSPASRPGAGSAGRGWLQDE VCLLLPPCGVRS-VFPPRPWPDPPSGTGCFGLSGCSLLLLQVMHMCLL in HSCOC4_PEA_1_P26 (SEQ ID NO:500).

It should be noted that the known protein sequence (CO4_HUMAN (SEQ ID NO:485)) has one or more changes than the sequence given at the end of the application and named as being the amino acid sequence for CO4_HUMAN_V1 (SEQ ID NO:486). These changes were previously known to occur and are listed in the table below. TABLE-US-00739 TABLE 46 Changes to CO4_HUMAN_V1 (SEQ ID NO: 486) SNP position(s) on amino acid sequence Type of change 1177 variant 1202 variant 1208 variant 1211 variant 1287 variant The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P26 (SEQ ID NO:500) also has the following non-silent SNPs (Single Nucleotide Polymorphisms) as listed in Table 47, (given according to their position(s) on the amino acid sequence, with the alternative amino acid(s) listed; the last column indicates whether the SNP is known or not; the presence of known SNPs in variant protein HSCOC4_PEA.sub.--1_P26 (SEQ ID NO:500) sequence provides support for the deduced sequence of this variant protein according to the present invention). TABLE-US-00740 TABLE 47 Amino acid mutations SNP position(s) on amino acid sequence Alternative amino acid(s) Previously known SNP? 128 Q→No 141 L→V Yes 183 G→No 211 G→No 322 A→No 322 A→V No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207 A→V Yes 1210 R→L Yes 1286 A→S Yes 1317 I→F Yes 1390 K→E No 1465 R→No 1632 A→G Yes 1663 P→Yes 1671 C→R Yes Variant protein HSCOC4_PEA.sub.--1_P26 (SEQ ID NO:500) is encoded by the following transcript(s): HSCOC4_PEA.sub.--1_T32 (SEQ ID NO:404), for which the sequence(s) is/are given at the end of the application. The coding portion of transcript HSCOC4_PEA.sub.--1_T32 (SEQ ID NO:404) is shown in bold; this coding portion starts at position 501 and ends at position 5573. The transcript also has the following SNPs as listed in Table 48 (given according to their position on the nucleotide sequence, with the alternative nucleic acid listed; the last column indicates whether the SNP is known or not; the presence of known SNPs in variant protein HSCOC4_PEA.sub.--1_P26 (SEQ ID NO:500) sequence provides support for the deduced sequence of this variant protein according to the present invention). TABLE-US-00741 TABLE 48 Nucleic acid SNPs SNP position on nucleotide sequence Alternative nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4226 G→A Yes 4232 C→G Yes 4235 G→A Yes 4356 G→T Yes 4449 A→T Yes 4668 A→G No 4760 T→C Yes 4894 G→No 5395 C→G Yes 5487 C→Yes 5511 T→C Yes 6050 G→C No 6093 G→A Yes 6103 A→C Yes 6278 A→C Yes 6284 G→A Yes 6349 A→C Yes 6407 C→T Yes 6672 C→T Yes 6691 C→T Yes 7424 C→A Yes 7644 C→T Yes 7809 A→C Yes Variant protein HSCOC4_PEA.sub.--1_P30 (SEQ ID NO:501) according to the present invention has an amino acid sequence as given at the end of the application; it is encoded by transcript(s) HSCOC4_PEA.sub.--1_T40 (SEQ ID NO:405). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P30 (SEQ ID NO:501) and CO4_HUMAN_V3 (SEQ ID NO: 487):

1. An isolated chimeric polypeptide encoding for HSCOC4_PEA.sub.--1_P30 (SEQ ID NO:501), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIPQ-TISELQLSVSAGSPHPAIARLTVMPPSGGPGFLSIERPD SRPPRVGDTLNLNLRAVGSGATFSHY-YYMILSRGQIVFMNREPKRTLTSVSVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLMSRYLDKTE-QWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGS corresponding to amino acids 1-1232 of CO4_HUMAN_V3 (SEQ ID NO:487), which also corresponds to amino acids 1-1232 of HSCOC4_PEA.sub.--1_P30 (SEQ ID NO:501), and a second amino acid sequence being at least 70%, optionally at least 80%, preferably at least 85%, more preferably at least 90% and most preferably at least 95% homologous to a polypeptide having the sequence RNPVRLLQPRAQMFCVLRGTK (SEQ ID NO:990) corresponding to amino acids 1233-1253 of HSCOC4_PEA.sub.--1.sub.P30 (SEQ ID NO:501), wherein said first amino acid sequence and second amino acid sequence are contiguous and in a sequential order.

2. An isolated polypeptide encoding for a tail of HSCOC4_PEA.sub.--1_P30 (SEQ ID NO:501), comprising a polypeptide being at least 70%, optionally at least about 80%, preferably at least about 85%, more preferably at least about 90% and most preferably at least about 95% homologous to the sequence RNPVRLLQPRAQMFCVLRGTK (SEQ ID NO:990) in HSCOC4_PEA.sub.--1_P30 (SEQ ID NO:501).

It should be noted that the known protein sequence (CO4_HUMAN (SEQ ID NO:485)) has one or more changes than the sequence given at the end of the application and named as being the amino acid sequence for CO4_HUMAN (SEQ ID NO:485)_V3 (SEQ ID NO:487). These changes were previously known to occur and are listed in the table below. TABLE-US-00742 TABLE 49 Changes to CO4_HUMAN (SEQ ID NO: 485) _V3 (SEQ ID NO: 487) SNP position(s) on amino acid sequence Type of change 1177 variant 1202 variant 1208 variant 1211 variant The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region program predicts that this protein has a trans-membrane region.

Variant protein HSCOC4_PEA.sub.--1_P30 (SEQ ID NO:501) also has the following non-silent SNPs (Single Nucleotide Polymorphisms) as listed in Table 50, (given according to their position(s) on the amino acid sequence, with the alternative amino acid(s) listed; the last column indicates whether the SNP is known or not; the presence of known SNPs in variant protein HSCOC4_PEA.sub.--1_P30 (SEQ ID NO:501) sequence provides support for the deduced sequence of this variant protein according to the present invention). TABLE-US-00743 TABLE 50 Amino acid mutations SNP position(s) on amino acid sequence Alternative amino acid(s) Previously known SNP? 128 Q→No 141 L→V Yes 183 G→No 211 G→No 322 A→No 322 A→V No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207 A→V Yes 1210 R→L Yes Variant protein HSCOC4_PEA.sub.--1_P30 (SEQ ID NO:501) is encoded by the following transcript(s): HSCOC4_PEA.sub.--1_T40 (SEQ ID NO:405), for which the sequence(s) is/are given at the end of the application. The coding portion of transcript HSCOC4_PEA.sub.--1_T40 (SEQ ID NO:405) is shown in bold; this coding portion starts at position 501 and ends at position 4259. The transcript also has the following SNPs as listed in Table 51 (given according to their position on the nucleotide sequence, with the alternative nucleic acid listed; the last column indicates whether the SNP is known or not; the presence of known SNPs in variant protein HSCOC4_PEA.sub.--1_P30 (SEQ ID NO:501) sequence provides support for the deduced sequence of this variant protein according to the present invention). TABLE-US-00744 TABLE 51 Nucleic acid SNPs SNP position on nucleotide sequence Alternative nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4348 C→G Yes 4559 G→C No 4602 G→A Yes 4612 A→C Yes 4787 A→C Yes 4793 G→A Yes 4858 A→C Yes Variant protein HSCOC4_PEA.sub.--1_P38 (SEQ ID NO:502) according to the present invention has an amino acid sequence as given at the end of the application; it is encoded by transcript(s) HSCOC4_PEA.sub.--1_T2 (SEQ ID NO:388). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P38 (SEQ ID NO:502) and CO4_HUMAN (SEQ ID NO:485):

1. An isolated chimeric polypeptide encoding for HSCOC4_PEA.sub.--1_P38 (SEQ ID NO:502), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIARLTVMPPSGGPGFLSIERPD SRPPRVGDTLNLNLRAVGSGATFSHY-YYMILSRGQIVFMNREPKRTLTSVSVFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKG corresponding to amino acids 1-818 of CO4_HUMAN (SEQ ID NO:485), which also corresponds to amino acids 1-818 of HSCOC4_PEA.sub.--1_P38 (SEQ ID NO:502), and a second amino acid sequence being at least 70%, optionally at least 80%, preferably at least 85%, more preferably at least 90% and most preferably at least 95% homologous to a polypeptide having the sequence DVTLSGPQVTLLPFPCTPAPCS-LCS (SEQ ID NO:978) corresponding to amino acids 819-843 of HSCOC4_PEA.sub.--1_P38 (SEQ ID NO:502), wherein said first amino acid sequence and second amino acid sequence are contiguous and in a sequential order.

2. An isolated polypeptide encoding for a tail of HSCOC4_PEA.sub.--1_P38 (SEQ ID NO:502) comprising a polypeptide being at least 70%, optionally at least about 80%, preferably at least about 85%, more preferably at least about 90% and most preferably at least about 95% homologous to the sequence DVTLSGPQVTLLPFPCTPAPCSLCS (SEQ ID NO:978) in HSCOC4_PEA.sub.--1_P38 (SEQ ID NO:502).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P38 (SEQ ID NO:502) also has the following non-silent SNPs (Single Nucleotide Polymorphisms) as listed in Table 52, (given according to their position(s) on the amino acid sequence, with the alternative amino acid(s) listed; the last column indicates whether the SNP is known or not; the presence of known SNPs in variant protein HSCOC4_PEA.sub.--1_P38 (SEQ ID NO:502) sequence provides support for the deduced sequence of this variant protein according to the present invention). TABLE-US-00745 TABLE 52 Amino acid mutations SNP position(s) on amino acid sequence Alternative amino acid(s) Previously known SNP? 128 Q→No 141 L→V Yes 183 G→No 211 G→No 322 A→No 322 A→V No 347 S→Y Yes 423 Q→No 478 P→L Yes 549 H→P Yes 608 L→V Yes 617 K→E Yes 726 P→L Yes 829 L→P Yes 830 L→I Yes 840 S→P Yes The glycosylation sites of variant protein HSCOC4_PEA.sub.--1_P38 (SEQ ID NO:502), as compared to the known protein Complement C4 precursor [Contains: C4a anaphylatoxin], are described in Table 53 (given according to their position(s) on the amino acid sequence in the first column; the second column indicates whether the glycosylation site is present in the variant protein; and the last column indicates whether the position is different on the variant protein). TABLE-US-00746 TABLE 53 Glycosylation site(s) Position(s) on known amino Present in acid sequence variant protein? Position in variant protein? 1391 no 862 no 226 yes 226 1328 no The phosphorylation sites of variant protein HSCOC4_PEA.sub.--1_P38 (SEQ ID NO:502), as compared to the known protein Complement C4 precursor [Contains: C4a anaphylatoxin], are described in Table 54 (given according to their position(s) on the amino acid sequence in the first column; the second column indicates whether the phosphorylation site is present in the variant protein; and the last column indicates whether the position is different on the variant protein). TABLE-US-00747 TABLE 54 Phosphorylation site(s) Position(s) on known amino acid sequence Present in variant protein? 1420 no 1422 no 1417 no Variant protein HSCOC4_PEA.sub.--1_P38 (SEQ ID NO:502) is encoded by the following transcript(s): HSCOC4_PEA.sub.--1_T2 (SEQ ID NO:388), for which the sequence(s) is/are given at the end of the application. The coding portion of transcript HSCOC4_PEA.sub.--1_T2 (SEQ ID NO:388) is shown in bold; this coding portion starts at position 501 and ends at position 3029. The transcript also has the following SNPs as listed in Table 55 (given according to their position on the nucleotide sequence, with the alternative nucleic acid listed; the last column indicates whether the SNP is known or not; the presence of known SNPs in variant protein HSCOC4_PEA1_P38 (SEQ ID NO:502) sequence provides support for the deduced sequence of this variant protein according to the present invention). TABLE-US-00748 TABLE 55 Nucleic acid SNPs SNP position on nucleotide sequence Alternative nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2986 T→C Yes 2988 C→A Yes 3018 T→C Yes 3070 C→T Yes 3081 C→A Yes 3093 A→G Yes 3101 G→A Yes 3106 G→A Yes 3174 G→A Yes 3193 A→G Yes 3201 T→C Yes 3233 C→T Yes 3373 T→C Yes 3404 G→T Yes 3477 G→A Yes 3635 A→C Yes 3714 T→C Yes 3869 G→T Yes 3976 A→G Yes 4043 C→A Yes 4117 C→T Yes 4120 G→C Yes 4128 T→A Yes 4131 G→C Yes 4133 C→T Yes 4285 G→A Yes 4292 T→C Yes 4373 C→G Yes 4378 C→T Yes 4387 G→T Yes 4388 G→C Yes 4484 G→A Yes 4490 C→G Yes 4493 G→A Yes 4614 G→T Yes 4707 A→T Yes 4926 A→G No 5018 T→C Yes 5152 G→No 5568 C→G Yes 5779 G→C No 5822 G→A Yes 5832 A→C Yes 6007 A→C Yes 6013 G→A Yes 6078 A→C Yes Variant protein HSCOC4_PEA.sub.--1_P39 (SEQ ID NO:503) according to the present invention has an amino acid sequence as given at the end of the application; it is encoded by transcript(s) HSCOC4_PEA.sub.--1_T5 (SEQ ID NO:391). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P39 (SEQ ID NO:503) and CO4_HUMAN (SEQ ID NO:485):

1. An isolated chimeric polypeptide encoding for HSCOC4_PEA.sub.--1_P39 (SEQ ID NO:503), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAPFLLQ corresponding to amino acids 1-387 of CO4_HUMAN (SEQ ID NO:485), which also corresponds to amino acids 1-387 of HSCOC4_PEA.sub.--1_P39 (SEQ ID NO:503), and a second amino acid sequence being at least 70%, optionally at least 80%, preferably at least 85%, more preferably at least 90% and most preferably at least 95% homologous to a polypeptide having the sequence VSSRGEG (SEQ ID NO:992) corresponding to amino acids 388-394 of HSCOC4_PEA.sub.--1_P39 (SEQ ID NO:503), wherein said first amino acid sequence and second amino acid sequence are contiguous and in a sequential order.

2. An isolated polypeptide encoding for a tail of HSCOC4_PEA.sub.--1_P39 (SEQ ID NO:503), comprising a polypeptide being at least 70%, optionally at least about 80%, preferably at least about 85%, more preferably at least about 90% and most preferably at least about 95% homologous to the sequence VSSRGEG (SEQ ID NO:992) in HSCOC4_PEA.sub.--1_P39 (SEQ ID NO:503).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P39 (SEQ ID NO:503) also has the following non-silent SNPs (Single Nucleotide Polymorphisms) as listed in Table 56, (given according to their position(s) on the amino acid sequence, with the alternative amino acid(s) listed; the last column indicates whether the SNP is known or not; the presence of known SNPs in variant protein HSCOC4_PEA.sub.--1_P39 (SEQ ID NO:503) sequence provides support for the deduced sequence of this variant protein according to the present invention). TABLE-US-00749 TABLE 56 Amino acid mutations SNP position(s) on amino acid sequence Alternative amino acid(s) Previously known SNP? 128 Q→No 141 L→V Yes 183 G→No 211 G→No 322 A→No 322 A→V No 347 S→Y Yes The glycosylation sites of variant protein HSCOC4_PEA.sub.--1_P39 (SEQ ID NO:503), as compared to the known protein Complement C4 precursor [Contains: C4a anaphylatoxin], are described in Table 57 (given according to their position(s) on the amino acid sequence in the first column; the second column indicates whether the glycosylation site is present in the variant protein; and the last column indicates whether the position is different on the variant protein). TABLE-US-00750 TABLE 57 Glycosylation site(s) Position(s) on known amino Present in acid sequence variant protein? Position in variant protein? 1391 no 862 no 226 yes 226 1328 no The phosphorylation sites of variant protein HSCOC4_PEA.sub.--1_P39 (SEQ ID NO:503), as compared to the known protein Complement C4 precursor [Contains: C4a anaphylatoxin], are described in Table 58 (given according to their position(s) on the amino acid sequence in the first column; the second column indicates whether the phosphorylation site is present in the variant protein; and the last column indicates whether the position is different on the variant protein). TABLE-US-00751 TABLE 58 Phosphorylation site(s) Position(s) on known amino acid sequence Present in variant protein? 1420 no 1422 no 1417 no Variant protein HSCOC4_PEA.sub.--1_P39 (SEQ ID NO:503) is encoded by the following transcript(s): HSCOC4_PEA.sub.--1_T5 (SEQ ID NO:391), for which the sequence(s) is/are given at the end of the application. The coding portion of transcript HSCOC4_PEA.sub.--1_T5 (SEQ ID NO:391) is shown in bold; this coding portion starts at position 501 and ends at position 1682. The transcript also has the following SNPs as listed in Table 59 (given according to their position on the nucleotide sequence, with the alternative nucleic acid listed; the last column indicates whether the SNP is known or not; the presence of known SNPs in variant protein HSCOC4_PEA.sub.--1_P39 (SEQ ID NO:503) sequence provides support for the deduced sequence of this variant protein according to the present invention). TABLE-US-00752 TABLE 59 Nucleic acid SNPs SNP position on nucleotide sequence Alternative nucleic acid Previously known SNP? 304 A→G Yes 884 G→No 921 C→G Yes 1049 C→No 1131 G→No 1465 C→No 1465 C→T No 1517 C→T Yes 1540 C→A Yes 1742 C→A Yes 1756 C→A Yes 1867 A→No 1877 C→T Yes 2032 C→T Yes 2084 C→T Yes 2245 A→C Yes 2261 G→A Yes 2421 C→G Yes 2448 A→G Yes 2534 G→A Yes 2639 C→T No 2776 C→T Yes 3074 C→T Yes 3214 T→C Yes 3245 G→T Yes 3318 G→A Yes 3476 A→C Yes 3555 T→C Yes 3710 G→T Yes 3817 A→G Yes 3884 C→A Yes 3958 C→T Yes 3961 G→C Yes 3969 T→A Yes 3972 G→C Yes 3974 C→T Yes 4126 G→A Yes 4133 T→C Yes 4214 C→G Yes 4219 C→T Yes 4228 G→T Yes 4229 G→C Yes 4325 G→A Yes 4331 C→G Yes 4334 G→A Yes 4455 G→T Yes 4548 A→T Yes 4767 A→G No 4859 T→C Yes 4993 G→No 5409 C→G Yes 5620 G→C No 5663 G→A Yes 5673 A→C Yes 5848 A→C Yes 5854 G→A Yes 5919 A→C Yes Variant protein HSCOC4_PEA.sub.--1_P40 (SEQ ID NO:504) according to the present invention has an amino acid sequence as given at the end of the application; it is encoded by transcript(s) HSCOC4_PEA.sub.--1_T7 (SEQ ID NO:392). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P40 (SEQ ID NO:504) and CO4_HUMAN (SEQ ID NO:485):

1. An isolated chimeric polypeptide encoding for HSCOC4_PEA.sub.--1_P40 (SEQ ID NO:504), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKY corresponding to amino acids 1-236 of CO4_HUMAN (SEQ ID NO:485), which also corresponds to amino acids 1-236 of HSCOC4_PEA.sub.--1_P40 (SEQ ID NO:504), and a second amino acid sequence being at least 70%, optionally at least 80%, preferably at least 85%, more preferably at least 90% and most preferably at least 95% homologous to a polypeptide having the sequence AGEWTEPHFPLKGRVPGRPGE-AEYGHY (SEQ ID NO:993) corresponding to amino acids 237-263 of HSCOC4_PEA.sub.--1_P40 (SEQ ID NO:504), wherein said first amino acid sequence and second amino acid sequence are contiguous and in a sequential order.

2. An isolated polypeptide encoding for a tail of HSCOC4_PEA.sub.--1_P40 (SEQ ID NO:504), comprising a polypeptide being at least 70%, optionally at least about 80%, preferably at least about 85%, more preferably at least about 90% and most preferably at least about 95% homologous to the sequence AGEWTEPHFPLKGRVPGRPGE-AEYGHY (SEQ ID NO:993) in HSCOC4_PEA.sub.--1_P40 (SEQ ID NO:504).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P40 (SEQ ID NO:504) also has the following non-silent SNPs (Single Nucleotide Polymorphisms) as listed in Table 60, (given according to their position(s) on the amino acid sequence, with the alternative amino acid(s) listed; the last column indicates whether the SNP is known or not; the presence of known SNPs in variant protein HSCOC4_PEA.sub.--1_P40 (SEQ ID NO:504) sequence provides support for the deduced sequence of this variant protein according to the present invention). TABLE-US-00753 TABLE 60 Amino acid mutations SNP position(s) on amino acid sequence Alternative amino acid(s) Previously known SNP? 128 Q→No 141 L→V Yes 183 G→No 211 G→No 254 R→No The glycosylation sites of variant protein HSCOC4_PEA.sub.--1_P40 (SEQ ID NO:504), as compared to the known protein Complement C4 precursor [Contains: C4a anaphylatoxin], are described in Table 61 (given according to their position(s) on the amino acid sequence in the first column; the second column indicates whether the glycosylation site is present in the variant protein; and the last column indicates whether the position is different on the variant protein). TABLE-US-00754 TABLE 61 Glycosylation site(s) Position(s) on known amino Present in acid sequence variant protein? Position in variant protein? 1391 no 862 no 226 yes 226 1328 no The phosphorylation sites of variant protein HSCOC4_PEA.sub.--1_P40 (SEQ ID NO:504), as compared to the known protein Complement C4 precursor [Contains: C4a anaphylatoxin], are described in Table 62 (given according to their position(s) on the amino acid sequence in the first column; the second column indicates whether the phosphorylation site is present in the variant protein; and the last column indicates whether the position is different on the variant protein). TABLE-US-00755 TABLE 62 Phosphorylation site(s) Position(s) on known amino acid sequence Present in variant protein? 1420 no 1422 no 1417 no Variant protein HSCOC4_PEA.sub.--1_P40 (SEQ ID NO:504) is encoded by the following transcript(s):

HSCOC4_PEA.sub.--1_T7 (SEQ ID NO:392), for which the sequence(s) is/are given at the end of the application. The coding portion of transcript HSCOC4_PEA.sub.--1_T7 (SEQ ID NO:392) is shown in bold; this coding portion starts at position 501 and ends at position 1289. The transcript also has the following SNPs as listed in Table 63 (given according to their position on the nucleotide sequence, with the alternative nucleic acid listed; the last column indicates whether the SNP is known or not; the presence of known SNPs in variant protein HSCOC4_PEA.sub.--1_P40 (SEQ ID NO:504) sequence provides support for the deduced sequence variant protein according to the present invention). TABLE-US-00756 TABLE 63 Nucleic acid SNPs SNP position on nucleotide Alternative sequence nucleic acid Previously known SNP? 304A→G Yes 884 G→No 921 C→G Yes 1049 C→No 1131 G→No 1262 C→No 1262 C→T No 1314 C→T Yes 1337 C→A Yes 1565A→No 1575 C→T Yes 1730 C→T Yes 1782 C→T Yes 1943 A→C Yes 1959 G→A Yes 2119 C→G Yes 2146 A→G Yes 2232 G→A Yes 2337 C→T No 2474 C→T Yes 2772 C→T Yes 2912 T→C Yes 2943 G→T Yes 3016 G→A Yes 3174 A→C Yes 3253 T→C Yes 3408 G→T Yes 3515 A→G Yes 3582 C→A Yes 3656 C→T Yes 3659 G→C Yes 3667 T→A Yes 3670 G→C Yes 3672 C→T Yes 3824 G→A Yes 3831 T→C Yes 3912 C→G Yes 3917 C→T Yes 3926 G→T Yes 3927 G→C Yes 4023 G→A Yes 4029 C→G Yes 4032 G→A Yes 4153 G→T Yes 4246 A→T Yes 4465 A→G No 4557 T→C Yes 4691 G→No 5107 C→G Yes 5318 G→C No 5361 G→A Yes 5371 A→C Yes 5546 A→C Yes 5552 G→A Yes 5617 A→C Yes Variant protein HSCOC4_PEA.sub.--1_P41 (SEQ ID NO:505) according to the present invention has an amino acid sequence as given at the end of the application; it is encoded by transcript(s) HSCOC4_PEA.sub.--1_T8 (SEQ ID NO:393). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P41 (SEQ ID NO:505) and CO4_HUMAN_V1 (SEQ ID NO:486):

1. An isolated chimeric polypeptide encoding for HSCOC4_PEA.sub.--1_P41 (SEQ ID NO:505), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYMGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLMSRYLDKTE-QWSTLPPETKDHAVDLIQKGYMRIQQFRK ADGSYM-WLSRDSSTWLTAFVLKVLSLAQEQVGGS-PEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKWEEQESRV HYTVCIWRNGKVGLSGMAIADVTLLSGF-HALRADLEKLTSLSDRYVSHFETEGPHVLL YFDSV corresponding to amino acids 1-1529 of CO4_HUMAN_V1 (SEQ ID NO:486), which also corresponds to amino acids 1-1529 of HSCOC4_PEA.sub.--1_P41 (SEQ ID NO:505), and a second amino acid sequence being at least 70%, optionally at least 80%, preferably at least 85%, more preferably at least 90% and most preferably at least 95% homologous to a polypeptide having the sequence SGER (SEQ ID NO:984) corresponding to amino acids 1530-1533 of HSCOC4_PEA.sub.--1_P41 (SEQ ID NO:505), wherein said first amino acid sequence and second amino acid sequence are contiguous and in a sequential order.

2. An isolated polypeptide encoding for a tail of HSCOC4_PEA.sub.--1_P41 (SEQ ID NO:505), comprising a polypeptide being at least 70%, optionally at least about 80%, preferably at least about 85%, more preferably at least about 90% and most preferably at least about 95% homologous to the sequence SGER (SEQ ID NO:984) in HSCOC4_PEA.sub.--1_P41 (SEQ ID NO:505).

It should be noted that the known protein sequence (CO4_HUMAN (SEQ ID NO:485) has one or more changes than the sequence given at the end of the application and named as being the amino acid sequence for CO4_HUMAN_V1 (SEQ ID NO:486). These changes were previously known to occur and are listed in the table below. TABLE-US-00757 TABLE 64 Changes to CO4_HUMAN_V1 (SEQ ID NO: 486) SNP position(s) on amino acid sequence Type of change 1177 variant 1202 variant 1208 variant 1211 variant 1287 variant The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HSCOC4_PEA.sub.--1_P41 (SEQ ID NO:505) also has the following non-silent SNPs (Single Nucleotide Polymorphisms) as listed in Table 65, (given according to their position(s) on the amino acid sequence, with the alternative amino acid(s) listed; the last column indicates whether the SNP is known or not; the presence of known SNPs in variant protein HSCOC4_PEA.sub.--1_P41 (SEQ ID NO:505) sequence provides support for the deduced sequence of this variant protein according to the present invention). TABLE-US-00758 TABLE 65 Amino acid mutations SNP position(s) on amino acid Alternative sequence amino acid(s) Previously known SNP? 128 Q→No 141 L→V Yes 183 G→No 211 G→No 322 A→V No 322 A→No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207A→V Yes 1210 R→L Yes 1286A→S Yes 1317 I→F Yes 1390 K→E No 1465 R→No Variant protein HSCOC4_PEA.sub.--1_P41 (SEQ ID NO:505) is encoded by the following transcript(s): HSCOC4_PEA.sub.--1_T8 (SEQ ID NO:393), for which the sequence(s) is/are given at the end of the application. The coding portion of transcript HSCOC4_PEA.sub.--1_T8 (SEQ ID NO:393) is shown in bold; this coding portion starts at position 501 and ends at position 5099. The transcript also has the following SNPs as listed in Table 66 (given according to their position on the nucleotide sequence, with the alternative nucleic acid listed; the last column indicates whether the SNP is known or not; the presence of known SNPs in variant protein HSCOC4_PEA.sub.--1_P41 (SEQ ID NO:505) sequence provides support for the deduced sequence of this variant protein according to the present invention). TABLE-US-00759 TABLE 66 Nucleic acid SNPs SNP position on nucleotide Alternative sequence nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4226 G→A Yes 4232 C→G Yes 4235 G→A Yes 4356 G→T Yes 4449 A→T Yes 4668 A→G No 4760 T→C Yes 4894 G→No 5561 G→A Yes 6026 T→G Yes 6348 G→C Yes 6801 C→G Yes 7012 G→C No 7055 G→A Yes 7065 A→C Yes 7240 A →C Yes 7246 G→A Yes 7311 A→C Yes Variant protein HSCOC4_PEA.sub.--1_P42 (SEQ ID NO:506) according to the present invention has an amino acid sequence as given at the end of the application; it is encoded by transcript(s) HSCOC4_PEA.sub.--1_T12 (SEQ ID NO:395). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA.sub.--1_P42 (SEQ ID NO:506) and CO4_HUMAN_V1 (SEQ ID NO:486):

1. An isolated chimeric polypeptide encoding for HSCOC4_PEA.sub.--1_P42 (SEQ ID NO:506), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYMWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKWEEQESRV HYTVCIW corresponding to amino acids 1-1473 of CO4_HUMAN_V1 (SEQ ID NO:486), which also corresponds to amino acids 1-1473 of HSCOC4_PEA.sub.--1_P42 (SEQ ID NO:506), a second amino acid sequence being at least 70%, optionally at least 80%, preferably at least 85%, more preferably at least 90% and most preferably at least 95% homologous to a polypeptide having the sequence WAP-GAALGQGREGRTQAGAGLLEPAQAEPGRQLTRLHR (SEQ ID NO:1021) corresponding to amino acids 1474-1511 of HSCOC4_PEA.sub.--1_P42 (SEQ ID NO:506), a third amino acid sequence being at least 90% homologous to RNGKVGLSGMAIADVTLLSGFHALRADLEK corresponding to amino acids 1474-1503 of CO4_HUMAN_V1 (SEQ ID NO:486), which also corresponds to amino acids 1512-1541 of HSCOC4_PEA.sub.--1_P42 (SEQ ID NO:506), and a fourth amino acid sequence being at least 70%, optionally at least 80%, preferably at least 85%, more preferably at least 90% and most preferably at least 95% homologous to a polypeptide having the sequence VWSATQGNPLCPRY (SEQ ID NO:995) corresponding to amino acids 1542-1555 of HSCOC4_PEA.sub.--1_P42 (SEQ ID NO:506), wherein said first amino acid sequence, second amino acid sequence, third amino acid sequence and fourth amino acid sequence are contiguous and in a sequential order.

2. An isolated polypeptide encoding for an edge portion of HSCOC4_PEA.sub.--1_P42 (SEQ ID NO:506), comprising an amino acid sequence being at least 70%, optionally at least about 80%, preferably at least about 85%, more preferably at least about 90% and most preferably at least about 95% homologous to the sequence encoding for WAPGMLGQGREGRTQAGAGLLEPAQAEPGRQLTRLHR (SEQ ID NO: 1021), corresponding to HSCOC4_PEA.sub.--1_P42 (SEQ ID NO:506).

3. An isolated polypeptide encoding for a tail of HSCOC4_PEA.sub.--1_P42 (SEQ ID NO:506), comprising a polypeptide being at least 70%, optionally at least about 80%, preferably at least about 85%, more preferably at least about 90% and most preferably at least about 95% homologous to the sequence VWSATQGNPLCPRY (SEQ ID NO:995) in HSCOC4_PEA.sub.--1_P42 (SEQ ID NO:506).

It should be noted that the known protein sequence (CO4_HUMAN (SEQ ID NO:485)) has one or more changes than the sequence given at the end of the application and named as being the amino acid sequence for CO4_HUMAN_V1 (SEQ ID NO:486). These changes were previously known to occur and are listed in the table below. TABLE-US-00760 TABLE 67 Changes to CO4_HUMAN_V1 (SEQ ID NO: 486) SNP position(s) on amino acid sequence Type of change 1177 variant 1202 variant 1208 variant 1211 variant 1287 variant The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA.sub.--1_P42 (SEQ ID NO:506) also has the following non-silent SNPs (Single Nucleotide Polymorphisms) as listed in Table 68, (given according to their position(s) on the amino acid sequence, with the alternative amino acid(s) listed; the last column indicates whether the SNP is known or not; the presence of known SNPs in variant protein HSCOC4_PEA.sub.--1_P42 (SEQ ID NO:506) sequence provides support for the deduced sequence s variant protein according to the present invention). TABLE-US-00761 TABLE 68 Amino acid mutations SNP position(s) on amino acid Alternative sequence amino acid(s) Previously known SNP? 128 Q→No 141 L→V Yes 183 G→No 211 G→No 322 A→V No 322 A→No 347 S→Y Yes 423 Q→No 478 P→L Yes 549 H→P Yes 608 L→V Yes 617 K→E Yes 726 P→L Yes 872 V→A Yes 907 A→T Yes 959 E→D Yes 1073 D→G Yes 1120 P→L Yes 1121 C→S Yes 1124 L→I Yes 1125 D→H Yes 1176 S→N Yes 1207A→V Yes 1210 R→L Yes 1286A→S Yes 1317 I→F Yes 1390 K→E No 1465 R→No Variant protein HSCOC4_PEA.sub.--1_P42 (SEQ ID NO:506) is encoded by the following transcript(s): HSCOC4_PEA.sub.--1_T12 (SEQ ID NO:395), for which the sequence(s) is/are given at the end of the application. The coding portion of transcript HSCOC4_PEA.sub.--1_T12 (SEQ ID NO:395) is shown in bold; this coding portion starts at position 501 and ends at position 5165. The transcript also has the following SNPs as listed in Table 69 (given according to their position on the nucleotide sequence, with the alternative nucleic acid listed; the last column indicates whether the SNP is known or not; the presence of known SNPs in variant protein HSCOC4_PEA.sub.--1_P42 (SEQ ID NO:506) sequence provides support for the deduced sequence of this variant protein according to the present invention). TABLE-US-00762 TABLE 69 Nucleic acid SNPs SNP position on nucleotide Alternative sequence nucleic acid Previously known SNP? 304 A→G Yes 884 G→No 921 C→G Yes 1049 C→No 1131 G→No 1465 C→No 1465 C→T No 1517 C→T Yes 1540 C→A Yes 1768 A→No 1778 C→T Yes 1933 C→T Yes 1985 C→T Yes 2146 A→C Yes 2162 G→A Yes 2322 C→G Yes 2349 A→G Yes 2435 G→A Yes 2540 C→T No 2677 C→T Yes 2975 C→T Yes 3115 T→C Yes 3146 G→T Yes 3219 G→A Yes 3377 A→C Yes 3456 T→C Yes 3611 G→T Yes 3718 A→G Yes 3785 C→A Yes 3859 C→T Yes 3862 G→C Yes 3870 T→A Yes 3873 G→C Yes 3875 C→T Yes 4027 G→A Yes 4034 T→C Yes 4115 C→G Yes 4120 C→T Yes 4129 G→T Yes 4130 G→C Yes 4226 G→A Yes 4232 C→G Yes 4235 G→A Yes 4356 G→T Yes 4449 A→T Yes 4668 A→G No 4760 T→C Yes 4894 G→No 5765 G→A Yes 6230 T→G Yes 6552 G→C Yes 7005 C→G Yes 7216 G→C No 7259 G→A Yes 7269 A→C Yes 7444 A→C Yes 7450 G→A Yes 7515 A→C Yes As noted above, cluster HSCOC4 features 79 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSCOC4_PEA.sub.--1_node.sub.--1 (SEQ ID NO:406) according to the present invention is supported by 24 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 70 below describes the starting and ending position of this segment on each transcript. TABLE-US-00763 TABLE 70 Segment location on transcripts Segment Segment Transcript name starting position ending position HSCOC4_PEA__1_T1 (SEQ ID 1 535 NO: 387) HSCOC4_PEA__1_T2 (SEQ ID 1 535 NO: 388) HSCOC4_PEA__1_T3 (SEQ ID 1 535 NO: 389) HSCOC4_PEA__1_T4 (SEQ ID 1 535 NO: 390) HSCOC4_PEA__1_T5 (SEQ ID 1 535 NO: 391) HSCOC4_PEA__1_T7 (SEQ ID 1 535 NO: 392)

HSCOC4_PEA_1_T8 (SEQ ID 1 535 NO: 393)
HSCOC4_PEA_1_T11 (SEQ ID 1 535 NO: 394)
HSCOC4_PEA_1_T12 (SEQ ID 1 535 NO: 395)
HSCOC4_PEA_1_T14 (SEQ ID 1 535 NO: 396)
HSCOC4_PEA_1_T15 (SEQ ID 1 535 NO: 397)
HSCOC4_PEA_1_T20 (SEQ ID 1 535 NO: 398)
HSCOC4_PEA_1_T21 (SEQ ID 1 535 NO: 399)
HSCOC4_PEA_1_T25 (SEQ ID 1 535 NO: 400)
HSCOC4_PEA_1_T28 (SEQ ID 1 535 NO: 401)
HSCOC4_PEA_1_T30 (SEQ ID 1 535 NO: 402)
HSCOC4_PEA_1_T31 (SEQ ID 1 535 NO: 403)
HSCOC4_PEA_1_T32 (SEQ ID 1 535 NO: 404)
HSCOC4_PEA_1_T40 (SEQ ID 1 535 NO: 405)

Segment cluster HSCOC4_PEA.sub.--1_node.sub.--5 (SEQ ID NO:407) according to the present invention is supported by 29 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 71 below describes the starting and ending position of this segment on each transcript. TABLE-US-00764 TABLE 71 Segment location on transcripts Segment Segment Transcript name starting position ending position HSCOC4_PEA_ 1_T1 (SEQ ID 566 764 NO: 387) HSCOC4_PEA_1_T2 (SEQ ID 566 764 NO: 388) HSCOC4_PEA_1_T3 (SEQ ID 566 764 NO: 389) HSCOC4_PEA_1_T4 (SEQ ID 566 764 NO: 390) HSCOC4_PEA_1_T5 (SEQ ID 566 764 NO: 391) HSCOC4_PEA_1_T7 (SEQ ID 566 764 NO: 392) HSCOC4_PEA_1_T8 (SEQ ID 566 764 NO: 393) HSCOC4_PEA_1_T11 (SEQ ID 566 764 NO: 394) HSCOC4_PEA_1_T12 (SEQ ID 566 764 NO: 395) HSCOC4_PEA_1_T14 (SEQ ID 566 764 NO: 396) HSCOC4_PEA_1_T15 (SEQ ID 566 764 NO: 397) HSCOC4_PEA_1_T20 (SEQ ID 566 764 NO: 398) HSCOC4_PEA_1_T21 (SEQ ID 566 764 NO: 399) HSCOC4_PEA_1_T25 (SEQ ID 566 764 NO: 400) HSCOC4_PEA_1_T28 (SEQ ID 566 764 NO: 401) HSCOC4_PEA_1_T30 (SEQ ID 566 764 NO: 402) HSCOC4_PEA_1_T31 (SEQ ID 566 764 NO: 403) HSCOC4_PEA_1_T32 (SEQ ID 566 764 NO: 404) HSCOC4_PEA_1_T40 (SEQ ID 566 764 NO: 405)

Segment cluster HSCOC4_PEA.sub.--1_node.sub.--7 (SEQ ID NO:408) according to the present invention is supported by 35 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 72 below describes the starting and ending position of this segment on each transcript. TABLE-US-00765 TABLE 72 Segment location on transcripts Segment Segment Transcript name starting position ending position HSCOC4_PEA_ 1_T1 (SEQ ID 765 885 NO: 387) HSCOC4_PEA_1_T2 (SEQ ID 765 885 NO: 388) HSCOC4_PEA_1_T3 (SEQ ID 765 885 NO: 389) HSCOC4_PEA_1_T4 (SEQ ID 765 885 NO: 390) HSCOC4_PEA_1_T5 (SEQ ID 765 885 NO: 391) HSCOC4_PEA_1_T7 (SEQ ID 765 885 NO: 392) HSCOC4_PEA_1_T8 (SEQ ID 765 885 NO: 393) HSCOC4_PEA_1_T11 (SEQ ID 765 885 NO: 394) HSCOC4_PEA_1_T12 (SEQ ID 765 885 NO: 395) HSCOC4_PEA_1_T14 (SEQ ID 765 885 NO: 396) HSCOC4_PEA_1_T15 (SEQ ID 765 885 NO: 397) HSCOC4_PEA_1_T20 (SEQ ID 765 885 NO: 398) HSCOC4_PEA_1_T21 (SEQ ID 765 885 NO: 399) HSCOC4_PEA_1_T25 (SEQ ID 765 885 NO: 400) HSCOC4_PEA_1_T28 (SEQ ID 765 885 NO: 401) HSCOC4_PEA_1_T30 (SEQ ID 765 885 NO: 402) HSCOC4_PEA_1_T31 (SEQ ID 765 885 NO: 403) HSCOC4_PEA_1_T32 (SEQ ID 765 885 NO: 404) HSCOC4_PEA_1_T40 (SEQ ID 765 885 NO: 405)

Segment cluster HSCOC4_PEA.sub.--1_node.sub.--30 (SEQ ID NO:409) according to the present invention is supported by 35 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4.sub.PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 73 below describes the starting and ending position of this segment on each transcript. TABLE-US-00766 TABLE 73 Segment location on transcripts Segment Segment Transcript name starting position ending position HSCOC4_PEA_ 1_T1 (SEQ ID 1662 1841 NO: 387) HSCOC4_PEA_1_T2 (SEQ ID 1662 1841 NO: 388) HSCOC4_PEA_1_T3 (SEQ ID 1662 1841 NO: 389) HSCOC4_PEA_1_T4 (SEQ ID 1662 1841 NO: 390) HSCOC4_PEA_1_T5 (SEQ ID 1761

1940 NO: 391) HSCOC4_PEA__1_T7 (SEQ ID 1459 1638 NO: 392) HSCOC4_PEA__1_T8 (SEQ ID 1662 1841 NO: 393) HSCOC4_PEA__1_T11 (SEQ ID 1662 1841 NO: 394) HSCOC4_PEA__1_T12 (SEQ ID 1662 1841 NO: 395) HSCOC4_PEA__1_T14 (SEQ ID 1662 1841 NO: 396) HSCOC4_PEA__1_T15 (SEQ ID 1662 1841 NO: 397) HSCOC4_PEA__1_T20 (SEQ ID 1662 1841 NO: 398) HSCOC4_PEA__1_T21 (SEQ ID 1662 1841 NO: 399) HSCOC4_PEA__1_T25 (SEQ ID 1662 1841 NO: 400) HSCOC4_PEA__1_T28 (SEQ ID 1662 1841 NO: 401) HSCOC4_PEA__1_T30 (SEQ ID 1662 1841 NO: 402) HSCOC4_PEA__1_T31 (SEQ ID 1662 1841 NO: 403) HSCOC4_PEA__1_T32 (SEQ ID 1662 1841 NO: 404) HSCOC4_PEA__1_T40 (SEQ ID 1662 1841 NO: 405)

Segment cluster HSCOC4_PEA.sub.--1_node.sub.--33 (SEQ ID NO:410) according to the present invention is supported by 30 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 74 below describes the starting and ending position of this segment on each transcript. TABLE-US-00767 TABLE 74 Segment location on transcripts Segment Segment Transcript name starting position ending position HSCOC4_PEA__1_T1 (SEQ ID 1842 2024 NO: 387) HSCOC4_PEA__1_T2 (SEQ ID 1842 2024 NO: 388) HSCOC4_PEA__1_T3 (SEQ ID 1842 2024 NO: 389) HSCOC4_PEA__1_T4 (SEQ ID 1842 2024 NO: 390) HSCOC4_PEA__1_T5 (SEQ ID 1941 2123 NO: 391) HSCOC4_PEA__1_T7 (SEQ ID 1639 1821 NO: 392) HSCOC4_PEA__1_T8 (SEQ ID 1842 2024 NO: 393) HSCOC4_PEA__1_T11 (SEQ ID 1842 2024 NO: 394) HSCOC4_PEA__1_T12 (SEQ ID 1842 2024 NO: 395) HSCOC4_PEA__1_T14 (SEQ ID 1842 2024 NO: 396) HSCOC4_PEA__1_T15 (SEQ ID 1842 2024 NO: 397) HSCOC4_PEA__1_T20 (SEQ ID 1842 2024 NO: 398) HSCOC4_PEA__1_T21 (SEQ ID 1842 2024 NO: 399) HSCOC4_PEA__1_T25 (SEQ ID 1842 2024 NO: 400) HSCOC4_PEA__1_T28 (SEQ ID 1842 2024 NO: 401) HSCOC4_PEA__1_T30 (SEQ ID 1842 2024 NO: 402) HSCOC4_PEA__1_T31 (SEQ ID 1842 2024 NO: 403) HSCOC4_PEA__1_T32 (SEQ ID 1842 2024 NO: 404) HSCOC4_PEA__1_T40 (SEQ ID 1842 2024 NO: 405)

Segment cluster HSCOC4_PEA.sub.--1_node.sub.--35 (SEQ ID NO:411) according to the present invention is supported by 31 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 75 below describes the starting and ending position of this segment on each transcript. TABLE-US-00768 TABLE 75 Segment location on transcripts Segment Segment Transcript name starting position ending position HSCOC4_PEA__1_T1 (SEQ ID 2025 2210 NO: 387) HSCOC4_PEA__1_T2 (SEQ ID 2025 2210 NO: 388) HSCOC4_PEA__1_T3 (SEQ ID 2025 2210 NO: 389) HSCOC4_PEA__1_T4 (SEQ ID 2025 2210 NO: 390) HSCOC4_PEA__1_T5 (SEQ ID 2124 2309 NO: 391) HSCOC4_PEA__1_T7 (SEQ ID 1822 2007 NO: 392) HSCOC4_PEA__1_T8 (SEQ ID 2025 2210 NO: 393) HSCOC4_PEA__1_T11 (SEQ ID 2025 2210 NO: 394) HSCOC4_PEA__1_T12 (SEQ ID 2025 2210 NO: 395) HSCOC4_PEA__1_T14 (SEQ ID 2025 2210 NO: 396) HSCOC4_PEA__1_T15 (SEQ ID 2025 2210 NO: 397) HSCOC4_PEA__1_T20 (SEQ ID 2025 2210 NO: 398) HSCOC4_PEA__1_T21 (SEQ ID 2025 2210 NO: 399) HSCOC4 PEA__1_T25 (SEQ ID 2025 2210 NO: 400) HSCOC4_PEA__1_T28 (SEQ ID 2025 2210 NO: 401) HSCOC4_PEA__1_T30 (SEQ ID 2025 2210 NO: 402) HSCOC4_PEA__1_T31 (SEQ ID 2025 2210 NO: 403) HSCOC4_PEA__1_T32 (SEQ ID 2025 2210 NO: 404) HSCOC4_PEA__1_T40 (SEQ ID 2025 2210 NO: 405)

Segment cluster HSCOC4_PEA.sub.--1_node.sub.--37 (SEQ ID NO:412) according to the present invention is supported by 33 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 76 below describes the starting and ending position of this segment on each transcript. TABLE-US-00769 TABLE 76 Segment location on transcripts Segment Segment Transcript name starting position ending position HSCOC4_PEA__1_T1 (SEQ ID 2211 2369 NO: 387) HSCOC4_PEA__1_T2 (SEQ ID 2211 2369 NO: 388) HSCOC4_PEA__1_T3 (SEQ ID 2211 2369 NO: 389) HSCOC4_PEA__1_T4 (SEQ ID 2211 2369 NO: 390) HSCOC4_PEA__1_T5 (SEQ ID 2310 2468 NO: 391) HSCOC4_PEA__1_T7 (SEQ ID 2008 2166 NO: 392) HSCOC4_PEA__1_T8 (SEQ ID 2211 2369 NO: 393) HSCOC4_PEA__1__T11 (SEQ ID 2211 2369 NO: 394) HSCOC4_PEA__1_T12 (SEQ ID 2211 2369 NO: 395) HSCOC4_PEA__1_T14 (SEQ ID 2211 2369 NO: 396) HSCOC4_PEA__1_T15 (SEQ ID 2211 2369 NO: 397) HSCOC4_PEA__1_T20 (SEQ ID 2211 2369 NO: 398) HSCOC4_PEA__1_T21 (SEQ ID 2211 2369 NO: 399) HSCOC4_PEA__1_T25 (SEQ ID 2211 2369 NO: 400) HSCOC4_PEA__1_T28 (SEQ ID 2211 2369 NO: 401) HSCOC4_PEA__1_T30 (SEQ ID 2211 2369 NO: 402) HSCOC4_PEA__1_T31 (SEQ ID 2211 2369 NO: 403) HSCOC4_PEA__1_T32 (SEQ ID 2211 2369 NO: 404) HSCOC4_PEA__1_T40 (SEQ ID 2211 2369 NO: 405)

Segment cluster HSCOC4_PEA.sub.--1_node.sub.--39 (SEQ ID NO:413) according to the present invention is supported by 35 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 77 below describes the starting and ending position of this segment on each transcript. TABLE-US-00770 TABLE 77 Segment location on transcripts Segment Segment Transcript name starting position ending position HSCOC4_PEA__1_T1 (SEQ ID 2370 2496 NO: 387) HSCOC4_PEA__1_T2 (SEQ ID 2370 2496 NO: 388) HSCOC4_PEA__1_T3 (SEQ ID 2370 2496 NO: 389) HSCOC4_PEA__1_T4 (SEQ ID 2370 2496 NO: 390) HSCOC4_PEA__1_T5 (SEQ ID 2469 2595 NO: 391) HSCOC4_PEA__1_T7 (SEQ ID 2167 2293 NO: 392) HSCOC4_PEA__1_T8 (SEQ ID 2370 2496 NO: 393) HSCOC4_PEA__1_T1 (SEQ ID 2370 2496 NO: 394) HSCOC4_PEA__1_T12 (SEQ ID 2370 2496 NO: 395) HSCOC4_PEA__1_T14 (SEQ ID 2370 2496 NO: 396) HSCOC4_PEA__1_T15 (SEQ ID 2370 2496 NO: 397) HSCOC4_PEA__1_T20 (SEQ ID 2370 2496 NO: 398) HSCOC4_PEA__1_T21 (SEQ ID 2370 2496 NO: 399) HSCOC4_PEA__1_T25 (SEQ ID 2370 2496 NO: 400) HSCOC4_PEA__1_T28 (SEQ ID 2370 2496 NO: 401) HSCOC4_PEA__1_T30 (SEQ ID 2370 2496 NO: 402) HSCOC4_PEA__1_T31 (SEQ ID 2370 2496 NO: 403) HSCOC4_PEA__1_T32 (SEQ ID 2370 2496 NO: 404) HSCOC4_PEA__1_T40 (SEQ ID 2370 2496 NO: 405)

Segment cluster HSCOC4_PEA.sub.--1_node.sub.--43 (SEQ ID NO:414) according to the present invention is supported by 34 libraries. The number of libraries was determined as previously described. This segment can be found in the following transcript(s): HSCOC4_PEA.sub.--1_T1 (SEQ ID NO:387), HSCOC4_PEA.sub.--1.sub.--T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1.sub.--T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 78 below describes the starting and ending position of this segment on each transcript. TABLE-US-00771 TABLE 78 Segment location on transcripts Segment Segment Transcript name starting position ending position HSCOC4_PEA__1_T1 (SEQ ID 2572 2769 NO: 387) HSCOC4_PEA__1_T2 (SEQ ID 2572 2769 NO: 388) HSCOC4_PEA__1_T3 (SEQ ID 2572 2769 NO: 389) HSCOC4_PEA__1_T4 (SEQ ID 2572 2769 NO: 390) HSCOC4_PEA__1_T5 (SEQ ID 2671 2868 NO: 391) HSCOC4_PEA__1_T7 (SEQ ID 2369 2566 NO: 392) HSCOC4_PEA__1_T8 (SEQ ID 2572 2769 NO: 393) HSCOC4_PEA__1_T11 (SEQ ID 2572 2769 NO: 394) HSCOC4_PEA__1_T12 (SEQ ID 2572 2769 NO: 395) HSCOC4_PEA__1_T14 (SEQ ID 2572 2769 NO: 396) HSCOC4_PEA__1_T15 (SEQ ID 2572 2769 NO: 397) HSCOC4_PEA__1_T20 (SEQ ID 2572 2769 NO: 398) HSCOC4_PEA__1_T21 (SEQ ID 2572 2769 NO: 399) HSCOC4_PEA__1_T25 (SEQ ID 2572 2769 NO: 400) HSCOC4_PEA__1_T28 (SEQ ID 2572 2769 NO: 401) HSCOC4_PEA__1_T30 (SEQ ID 2572 2769 NO: 402) HSCOC4_PEA__1_T31 (SEQ ID 2572 2769 NO: 403) HSCOC4_PEA__1_T32 (SEQ ID 2572 2769 NO: 404) HSCOC4_PEA__1_T40 (SEQ ID 2572 2769 NO: 405)

Segment cluster HSCOC4_PEA.sub.--1_node.sub.--48 (SEQ ID NO:415) according to the present invention is supported by 2 libraries. The number of libraries was determined as previously described. This segment can be found in the following transcript(s): HSCOC4_PEA.sub.--1_T2 (SEQ ID NO:388) and HSCOC4_PEA.sub.--1_T3 (SEQ ID NO:389). Table 79 below describes the starting and ending position of this segment on each transcript. TABLE-US-00772 TABLE 79 Segment location on transcripts Segment Segment Transcript name starting position ending position HSCOC4_PEA__1_T2 (SEQ ID 2953 3210 NO: 388) HSCOC4_PEA__1_T3 (SEQ ID 2953 3210 NO: 389)

Segment cluster HSCOC4_PEA.sub.--1_node.sub.--49 (SEQ ID NO:416) according to the present invention is supported by 37 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 80 below describes the starting and ending position of this segment on each transcript. TABLE-US-00773 TABLE 80 Segment location on transcripts Segment Segment Transcript name starting position ending position HSCOC4_PEA__1_T1 (SEQ ID 2953 3092 NO: 387) HSCOC4_PEA__1_T2 (SEQ ID 3211 3350 NO: 388) HSCOC4_PEA__1_T3 (SEQ ID 3211 3350 NO: 389) HSCOC4_PEA__1_T4 (SEQ ID 2953 3092 NO: 390) HSCOC4_PEA__1_T5 (SEQ ID 3052 3191 NO: 391) HSCOC4_PEA__1_T7 (SEQ ID 2750 2889 NO: 392) HSCOC4_PEA__1_T8 (SEQ ID 2953 3092 NO: 393) HSCOC4_PEA__1_T11 (SEQ ID 2953 3092 NO: 394) HSCOC4_PEA__1_T12 (SEQ ID 2953 3092 NO: 395) HSCOC4_PEA__1_T14 (SEQ ID 2953 3092 NO: 396) HSCOC4_PEA__1_T15 (SEQ ID 2953 3092 NO: 397) HSCOC4_PEA__1_T20 (SEQ ID 2953 3092 NO: 398) HSCOC4_PEA__1_T21 (SEQ ID 2953 3092 NO: 399) HSCOC4_PEA__1_T25 (SEQ ID 2953 3092 NO: 400) HSCOC4_PEA__1_T28 (SEQ ID 2953 3092 NO: 401) HSCOC4_PEA__1_T30 (SEQ ID 2953 3092 NO: 402) HSCOC4_PEA__1_T31 (SEQ ID 2953 3092 NO: 403) HSCOC4_PEA__1_T32 (SEQ ID 2953 3092 NO: 404) HSCOC4_PEA__1_T40 (SEQ ID 2953 3092 NO: 405)

Segment cluster HSCOC4_PEA.sub.--1_node.sub.--51 (SEQ ID NO:417) according to the present invention is supported by 40 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 81 below describes the starting and ending position of this segment on each transcript. TABLE-US-00774 TABLE 81 Segment location on transcripts Segment Segment Transcript name starting position ending position HSCOC4_PEA__1_T1 (SEQ ID 3206 3415 NO: 387) HSCOC4_PEA__1_T2 (SEQ ID 3351 3560 NO: 388) HSCOC4_PEA__1_T3 (SEQ ID 3464 3673 NO: 389) HSCOC4_PEA__1_T4 (SEQ ID 3093 3302 NO: 390) HSCOC4_PEA__1_T5 (SEQ ID 3192 3401 NO: 391) HSCOC4_PEA__1_T7 (SEQ ID 2890 3099 NO: 392) HSCOC4_PEA__1_T8 (SEQ ID 3093 3302 NO: 393) HSCOC4_PEA__1_T11 (SEQ ID 3093 3302 NO: 394) HSCOC4_PEA__1_T12 (SEQ ID 3093 3302 NO: 395) HSCOC4_PEA__1_T14 (SEQ ID 3093 3302 NO: 396) HSCOC4_PEA__1_T15 (SEQ ID 3093 3302 NO: 397) HSCOC4_PEA__1_T20 (SEQ ID 3093 3302 NO: 398) HSCOC4_PEA__1_T21 (SEQ ID 3093 3302 NO: 399) HSCOC4_PEA__1_T25 (SEQ ID 3093 3302 NO: 400) HSCOC4_PEA__1_T28 (SEQ ID 3093 3302 NO: 401) HSCOC4_PEA__1_T30 (SEQ ID 3093 3302 NO: 402) HSCOC4_PEA__1_T31 (SEQ ID 3093 3302 NO: 403) HSCOC4_PEA__1_T32 (SEQ ID 3093 3302 NO: 404) HSCOC4_PEA__1_T40 (SEQ ID 3093 3302 NO: 405)

Segment cluster HSCOC4_PEA.sub.--1_node.sub.--58 (SEQ ID NO:418) according to the present invention is supported by 52 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ;ID NO:404) and HSCOC4_PEA.sub.--1_T40 (SEQ ID NO:405). Table 82 below describes the starting and ending position of this segment on each transcript. TABLE-US-00775 TABLE 82 Segment location on transcripts Segment Segment Transcript name starting position ending position HSCOC4_PEA__1_T1 (SEQ ID 3605 3767 NO: 387) HSCOC4_PEA__1_T2 (SEQ ID 3750 3912 NO: 388) HSCOC4_PEA__1_T3 (SEQ ID 3863 4025 NO: 389) HSCOC4_PEA__1_T4 (SEQ ID 3492 3654 NO: 390) HSCOC4_PEA__1_T5 (SEQ ID 3591 3753 NO: 391) HSCOC4_PEA__1_T7 (SEQ ID 3289 3451 NO: 392) HSCOC4_PEA__1_T8 (SEQ ID 3492 3654 NO: 393) HSCOC4_PEA__1_T11 (SEQ ID 3492 3654 NO: 394) HSCOC4_PEA__1_T12 (SEQ ID 3492 3654 NO: 395) HSCOC4_PEA__1_T14 (SEQ ID 3492 3654 NO: 396) HSCOC4_PEA__1_T15 (SEQ ID 3492 3654 NO: 397) HSCOC4_PEA__1_T20 (SEQ ID 3492 3654 NO: 398) HSCOC4_PEA__1_T21 (SEQ ID 3492 3654 NO: 399) HSCOC4_PEA__1_T25 (SEQ ID 3492 3654 NO: 400) HSCOC4_PEA__1_T28 (SEQ ID 3492 3654 NO: 401) HSCOC4_PEA__1_T30 (SEQ ID 3492 3654 NO: 402) HSCOC4_PEA__1_T31 (SEQ ID 3492 3654 NO: 403) HSCOC4_PEA__1_T32 (SEQ ID 3492 3654 NO: 404) HSCOC4_PEA__1_T40 (SEQ ID 3492 3654 NO: 405)

Segment cluster HSCOC4_PEA.sub.--1_node.sub.--59 (SEQ ID NO:419) according to the present invention is supported by 8 libraries. The number of libraries was determined as previously described. This segment can be found in the following transcript(s): HSCOC4_PEA.sub.--1_T4 (SEQ ID NO:390). Table 83 below describes the starting and ending position of this segment on each transcript. TABLE-US-00776 TABLE 83 Segment location on transcripts Segment Segment Transcript name starting position ending position HSCOC4_PEA__1_T4 (SEQ ID 3655 3833 NO: 390)

Segment cluster HSCOC4_PEA.sub.--1_node.sub.--62 (SEQ ID NO:420) according to the present invention is supported by 61 libraries. The number of libraries was determined as previously described. This segment can be found in the following transcript(s): HSCOC4_PEA.sub.--1_T1 (SEQ ID NO:387), HSCOC4_PEA.sub.--1.sub.--T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 84 below describes the starting and ending position of this segment on each transcript. TABLE-US-00777 TABLE 84 Segment location on transcripts Segment Segment Transcript name starting position ending position HSCOC4_PEA__1_T1 (SEQ ID 3844 4000 NO: 387) HSCOC4_PEA__1_T2 (SEQ ID 3989 4145 NO: 388) HSCOC4_PEA__1_T3 (SEQ ID 4102 4258 NO: 389) HSCOC4_PEA__1_T4 (SEQ ID 3910 4066 NO: 390) HSCOC4_PEA__1_T5 (SEQ ID 3830 3986 NO: 391) HSCOC4_PEA__1_T7 (SEQ ID 3528 3684 NO: 392) HSCOC4_PEA__1_T8 (SEQ ID 3731 3887 NO: 393) HSCOC4_PEA__1_T11 (SEQ ID 3731 3887 NO: 394) HSCOC4_PEA__1_T12 (SEQ ID 3731 3887 NO: 395) HSCOC4_PEA__1_T14 (SEQ ID 3731 3887 NO: 396) HSCOC4_PEA__1_T15 (SEQ ID 3731 3887 NO: 397) HSCOC4_PEA__1_T20 (SEQ ID 3731 3887 NO: 398) HSCOC4_PEA__1_T21 (SEQ ID 3731 3887 NO: 399) HSCOC4_PEA__1_T25 (SEQ ID 3731 3887 NO: 400) HSCOC4_PEA__1_T28 (SEQ ID 3731 3887 NO: 401) HSCOC4_PEA__1_T30 (SEQ ID 3731 3887 NO: 402) HSCOC4_PEA__1_T31 (SEQ ID 3731 3887 NO: 403) HSCOC4_PEA__1_T32 (SEQ ID 3731 3887 NO: 404) HSCOC4_PEA__1_T40 (SEQ ID 3731 3887 NO: 405)

Segment cluster HSCOC4_PEA.sub.--1_node.sub.--66 (SEQ ID NO:421) according to the present invention is supported by 65 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 85 below describes the starting and ending position of this segment on each transcript. TABLE-US-00778 TABLE 85 Segment location on transcripts Segment Segment Transcript name starting position ending position HSCOC4_PEA__1_T1 (SEQ ID 4118 4289 NO: 387) HSCOC4_PEA__1_T2 (SEQ ID 4263 4434 NO: 388) HSCOC4_PEA__1_T3 (SEQ ID 4376 4547 NO: 389) HSCOC4_PEA__1_T4 (SEQ ID 4184 4355 NO: 390) HSCOC4_PEA__1_T5 (SEQ ID 4104 4275 NO: 391) HSCOC4_PEA__1_T7 (SEQ ID 3802 3973 NO: 392) HSCOC4_PEA__1_T8 (SEQ ID 4005 4176 NO: 393) HSCOC4_PEA__1_T11 (SEQ ID 4005 4176 NO: 394) HSCOC4_PEA__1_T12 (SEQ ID 4005 4176 NO: 395) HSCOC4_PEA__1_T14 (SEQ ID 4005 4176 NO: 396) HSCOC4_PEA__1_T15 (SEQ ID 4005 4176 NO: 397) HSCOC4_PEA__1_T20 (SEQ ID 4005 4176 NO: 398) HSCOC4_PEA__1_T21 (SEQ ID 4005 4176 NO: 399) HSCOC4_PEA__1_T25 (SEQ ID 4005 4176 NO: 400) HSCOC4_PEA__1_T28 (SEQ ID 4005 4176 NO: 401) HSCOC4_PEA__1_T30 (SEQ ID 4005 4176 NO: 402) HSCOC4_PEA__1_T31 (SEQ ID 4005 4176 NO: 403) HSCOC4_PEA__1_T32 (SEQ ID 4005 4176 NO: 404) HSCOC4_PEA__1_T40 (SEQ ID 4005 4176 NO: 405)

Segment cluster HSCOC4_PEA.sub.--1_node.sub.--72 (SEQ ID NO:422) according to the present invention is supported by 65 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 86 below describes the starting and ending position of this segment on each transcript. TABLE-US-00779 TABLE 86 Segment location on transcripts Segment Segment Transcript name starting position ending position HSCOC4_PEA__1_T1 (SEQ ID 4392 4522 NO: 387) HSCOC4_PEA__1_T2 (SEQ ID 4537 4667 NO: 388) HSCOC4_PEA__1_T3 (SEQ ID 4650 4780 NO: 389) HSCOC4_PEA__1_T4 (SEQ ID 4458 4588 NO: 390) HSCOC4_PEA__1_T5 (SEQ ID 4378 4508 NO: 391) HSCOC4_PEA__1_T7 (SEQ ID 4076 4206 NO: 392) HSCOC4_PEA__1_T8 (SEQ ID 4279 4409 NO: 393) HSCOC4_PEA__1_T11 (SEQ ID 4279 4409 NO: 394) HSCOC4_PEA__1_T12 (SEQ ID 4279 4409 NO: 395) HSCOC4_PEA__1_T14 (SEQ ID 4279 4409 NO: 396) HSCOC4_PEA__1_T15 (SEQ ID 4279 4409 NO: 397) HSCOC4_PEA__1_T20 (SEQ ID 4279 4409 NO: 398) HSCOC4_PEA__1_T21 (SEQ ID 4279 4409 NO: 399) HSCOC4_PEA1_T25 (SEQ ID 4279 4409 NO: 400) HSCOC4_PEA__1_T28 (SEQ ID 4279 4409 NO: 401) HSCOC4_PEA__1_T30 (SEQ ID 4279 4409 NO: 402) HSCOC4_PEA__1_T31 (SEQ ID 4279 4409 NO: 403) HSCOC4_PEA__1_T32 (SEQ ID 4279 4409 NO: 404)

Segment cluster HSCOC4_PEA.sub.--1_node.sub.--77 (SEQ ID NO:423) according to the present invention is supported by 2 libraries. The number of libraries was determined as previously described. This segment can be found in the following transcript(s): HSCOC4_PEA.sub.--1_T14 (SEQ ID NO:396) and HSCOC4_PEA.sub.--1_T20 (SEQ ID NO:398). Table 87 below describes the starting and ending position of this segment on each transcript. TABLE-US-00780 TABLE 87 Segment location on transcripts Segment Segment Transcript name starting position ending position HSCOC4_PEA__1_T14 (SEQ ID 4578 4970 NO: 396) HSCOC4_PEA__1_T20 (SEQ ID 4660 5052 NO: 398)

Segment cluster HSCOC4_PEA.sub.--1_node.sub.--79 (SEQ ID NO:424) according to the present invention is supported by 6 libraries. The number of libraries was determined as previously described. This segment can be found in the following transcript(s): HSCOC4_PEA.sub.--1_T11 (SEQ ID NO:394). Table 88 below describes the starting and ending position of this segment on each transcript. TABLE-US-00781 TABLE 88 Segment location on transcripts Segment Segment Transcript name starting position ending position HSCOC4_PEA__1_T11 (SEQ ID 4638 5686 NO: 394)

Segment cluster HSCOC4_PEA.sub.--1_node.sub.--93 (SEQ ID NO:425) according to the present invention is supported by 25 libraries. The number of libraries was determined as previously described. This segment can be found in the following transcript(s): HSCOC4_PEA.sub.--1_T8 (SEQ ID NO:393), HSCOC4_PEA.sub.--1_T12 (SEQ ID NO:395) and HSCOC4_PEA.sub.--1_T21 (SEQ ID NO:399). Table 89 below describes the starting and ending position of this segment on each transcript. TABLE-US-00782 TABLE 89 Segment location on transcripts Segment Segment Transcript name starting position ending position HSCOC4_PEA__1_T8 (SEQ ID 5085 6566 NO: 393) HSCOC4_PEA__1_T12 (SEQ ID 5289 6770 NO: 395) HSCOC4_PEA__1_T21 (SEQ ID 5085 6566 NO: 399)

Segment cluster HSCOC4_PEA.sub.--1_node.sub.--100 (SEQ ID NO:426) according to the present invention is supported by 13 libraries. The number of libraries was determined as previously described. This segment can be found in the following transcript(s): HSCOC4_PEA.sub.--1_T21 (SEQ ID NO:399). Table 90 below describes the starting and ending position of this segment on each transcript. TABLE-US-00783 TABLE 90 Segment location on transcripts Segment Segment Transcript name starting position ending position HSCOC4_PEA__1_T21 (SEQ ID 6679 6843 NO: 399)

Segment cluster HSCOC4_PEA.sub.--1_node.sub.--105 (SEQ ID NO:427) according to the present invention is supported by 9 libraries. The number of libraries was determined as previously described. This segment can be found in the following transcript(s): HSCOC4_PEA.sub.--1_T28 (SEQ ID NO:401) and HSCOC4_PEA.sub.--1_T32 (SEQ ID NO:404). Table 91 below describes the starting and ending position of this segment on each transcript. TABLE-US-00784 TABLE 91 Segment location on transcripts Segment Segment Transcript name starting position ending position HSCOC4_PEA__1_T28 (SEQ ID 5377 5558 NO: 401) HSCOC4_PEA__1_T32 (SEQ ID 5462 5643 NO: 404)

Microarray (chip) data is also available for this segment as follows. As described above with regard to the cluster itself, various oligonucleotides were tested for being differentially expressed in various disease conditions, particularly cancer. The following oligonucleotides were found to hit this segment (with regard to breast cancer), shown in Table 92. TABLE-US-00785 TABLE 92 Oligonucleotides related to this segment Chip Oligonucleotide name Overexpressed in cancers reference HSCOC4__0__0__9883 (SEQ ID breast malignant tumors BRS NO: 909)

Segment cluster HSCOC4_PEA.sub.--1_node.sub.--107 (SEQ ID NO:428) according to the present invention is supported by 27 libraries. The number of libraries was determined as previously described. This segment can be found in the following transcript(s): HSCOC4_PEA.sub.--1_T25 (SEQ ID NO:400), HSCOC4_PEA.sub.--1_T28 (SEQ ID NO:401) and HSCOC4_PEA.sub.--1_T32 (SEQ ID NO:404). Table 93 below describes the starting and ending position of this segment on each transcript. TABLE-US-00786 TABLE 93 Segment location on transcripts Segment Segment Transcript name starting position ending position HSCOC4_PEA__1_T25 (SEQ ID 5461 5722 NO: 400) HSCOC4_PEA__1_T28 (SEQ ID 5643 5904 NO: 401) HSCOC4_PEA__1_T32 (SEQ ID 5728 5989 NO: 404)

Segment cluster HSCOC4_PEA.sub.--1_node.sub.--108 (SEQ ID NO:429) according to the present invention is supported by 120 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 94 below describes the starting and ending position of this segment on each transcript. TABLE-US-00787 TABLE 94 Segment location on transcripts Segment Segment Transcript name starting position ending position HSCOC4_PEA__1_T1 (SEQ ID 5574 5706 NO: 387) HSCOC4_PEA__1_T2 (SEQ ID 5719 5851 NO: 388) HSCOC4_PEA__1_T3 (SEQ ID 5832 5964 NO: 389) HSCOC4_PEA__1_T4 (SEQ ID 5640 5772 NO: 390) HSCOC4_PEA__1_T5 (SEQ ID 5560 5692 NO: 391) HSCOC4_PEA__1_T7 (SEQ ID 5258 5390 NO: 392) HSCOC4_PEA__1_T8 (SEQ ID 6952 7084 NO: 393) HSCOC4_PEA__1_T11 (SEQ ID 6510 6642 NO: 394) HSCOC4_PEA__1_T12 (SEQ ID 7156 7288 NO: 395) HSCOC4_PEA__1_T14 (SEQ ID 5854 5986 NO: 396) HSCOC4_PEA__1_T15 (SEQ ID 5414 5546 NO: 397) HSCOC4_PEA__1_T20 (SEQ ID 5936 6068 NO: 398) HSCOC4_PEA__1_T21 (SEQ ID 7117 7249 NO: 399) HSCOC4_PEA__1_T25 (SEQ ID 5723 5855 NO: 400) HSCOC4_PEA__1_T28 (SEQ ID 5905 6037 NO: 401) HSCOC4_PEA__1_T30 (SEQ ID 5358 5490 NO: 402) HSCOC4_PEA__1_T31 (SEQ ID 5546 5678 NO: 403) HSCOC4_PEA__1_T32 (SEQ ID 5990 6122 NO: 404) HSCOC4_PEA__1_T40 (SEQ ID 4499 4631 NO: 405)

Segment cluster HSCOC4_PEA.sub.--1_node.sub.--109 (SEQ ID NO:430) according to the present invention is supported by 12 libraries. The number of libraries was determined as previously described. This segment can be found in the following transcript(s): HSCOC4_PEA.sub.--1_T25 (SEQ ID NO:400) and HSCOC4_PEA.sub.--1_T28 (SEQ ID NO:401). Table 95 below describes the starting and ending position of this segment on each transcript. TABLE-US-00788 TABLE 95 Segment location on transcripts Segment Segment Transcript name starting position ending position HSCOC4_PEA__1_T25 (SEQ ID 5856 5998 NO: 400) HSCOC4_PEA__1_T28 (SEQ ID 6038 6180 NO: 401)

Segment cluster HSCOC4_PEA.sub.--1_node.sub.--110 (SEQ ID NO:431) according to the present invention is supported by 97 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 96 below describes the starting and ending position of this segment on each transcript. TABLE-US-00789 TABLE 96 Segment location on transcripts Segment Segment Transcript name starting position ending position HSCOC4_PEA_1_T1 (SEQ ID 5707 5856 NO: 387) HSCOC4_PEA_1_T2 (SEQ ID 5852 6001 NO: 388) HSCOC4_PEA_1_T3 (SEQ ID 5965 6114 NO: 389) HSCOC4_PEA_1_T4 (SEQ ID 5773 5922 NO: 390) HSCOC4_PEA_1_T5 (SEQ ID 5693 5842 NO: 391) HSCOC4_PEA_1_T7 (SEQ ID 5391 5540 NO: 392) HSCOC4_PEA_1_T8 (SEQ ID 7085 7234 NO: 393) HSCOC4_PEA_1_T11 (SEQ ID 6643 6792 NO: 394) HSCOC4_PEA_1_T12 (SEQ ID 7289 7438 NO: 395) HSCOC4_PEA_1_T14 (SEQ ID 5987 6136 NO: 396) HSCOC4_PEA_1_T15 (SEQ ID 5547 5696 NO: 397) HSCOC4_PEA_1_T20 (SEQ ID 6069 6218 NO: 398) HSCOC4_PEA_1_T21 (SEQ ID 7250 7399 NO: 399) HSCOC4_PEA_1_T25 (SEQ ID 5999 6148 NO: 400) HSCOC4_PEA_1_T28 (SEQ ID 6181 6330 NO: 401) HSCOC4_PEA_1_T30 (SEQ ID 5491 5640 NO: 402) HSCOC4_PEA_1_T31 (SEQ ID 5679 5828 NO: 403) HSCOC4_PEA_1_T32 (SEQ ID 6123 6272 NO: 404) HSCOC4_PEA_1_T40 (SEQ ID 4632 4781 NO: 405)

Segment cluster HSCOC4_PEA.sub.--1_node.sub.--112 (SEQ ID NO:432) according to the present invention is supported by 71 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 97 below describes the starting and ending position of this segment on each transcript. TABLE-US-00790 TABLE 97 Segment location on transcripts Segment Segment Transcript name starting position ending position HSCOC4_PEA_1_T1 (SEQ ID 5948 5989 NO: 387) HSCOC4_PEA_1_T2 (SEQ ID 6093 6134 NO: 388) HSCOC4_PEA_1_T3 (SEQ ID 6206 6247 NO: 389) HSCOC4_PEA_1_T4 (SEQ ID 6014 6055 NO: 390) HSCOC4_PEA_1_T5 (SEQ ID 5934 5975 NO: 391) HSCOC4_PEA_1_T7 (SEQ ID 5632 5673 NO: 392) HSCOC4_PEA_1_T8 (SEQ ID 7326 7367 NO: 393) HSCOC4_PEA_1_T11 (SEQ ID 6884 6925 NO: 394) HSCOC4_PEA_1_T12 (SEQ ID 7530 7571 NO: 395) HSCOC4_PEA_1_T14 (SEQ ID 6228 6269 NO: 396) HSCOC4_PEA_1_T15 (SEQ ID 5788 5829 NO: 397) HSCOC4_PEA_1_T20 (SEQ ID 6310 6351 NO: 398) HSCOC4_PEA_1_T21 (SEQ ID 7491 7532 NO: 399) HSCOC4_PEA_1_T25 (SEQ ID 6240 6619 NO: 400) HSCOC4_PEA_1_T28 (SEQ ID 6422 6801 NO: 401) HSCOC4_PEA_1_T30 (SEQ ID 5732 5773 NO: 402) HSCOC4_PEA_1_T31 (SEQ ID 5920 5961 NO: 403) HSCOC4_PEA_1_T32 (SEQ ID 6364 6743 NO: 404) HSCOC4_PEA_1_T40 (SEQ ID 4873 4914 NO: 405)

Segment cluster HSCOC4_PEA.sub.--1_node.sub.--113 (SEQ ID NO:433) according to the present invention is supported by 19 libraries. The number of libraries was determined as previously described. This segment can be found in the following transcript(s): HSCOC4_PEA.sub.--1_T25 (SEQ ID NO:400), HSCOC4_PEA.sub.--1_T28 (SEQ ID NO:401) and HSCOC4_PEA.sub.--1_T32 (SEQ ID NO:404). Table 98 below describes the starting and ending position of this segment on each transcript. TABLE-US-00791 TABLE 98 Segment location on transcripts Segment Segment Transcript name starting position ending position HSCOC4_PEA_1_T25 (SEQ ID 6620 7765 NO: 400) HSCOC4_PEA_1_T28 (SEQ ID 6802 7947 NO: 401) HSCOC4_PEA_1_T32 (SEQ ID 6744 7889 NO: 404)

According to an optional embodiment of the present invention, short segments related to the above cluster are also provided. These segments are up to about 120 bp in length, and so are included in a separate description.

Segment cluster HSCOC4_PEA.sub.--1_node.sub.--2 (SEQ ID NO:434) according to the present invention is supported by 25 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 99 below describes the starting and ending position of this segment on each transcript. TABLE-US-00792 TABLE 99 Segment location on transcripts Segment Segment Transcript name starting position ending position HSCOC4_PEA_1_T1 (SEQ ID 536 565 NO: 387) HSCOC4_PEA_1_T2

(SEQ ID 536 565 NO: 388) HSCOC4_PEA__1_T3 (SEQ ID 536 565 NO: 389) HSCOC4_PEA__1_T4 (SEQ ID 536 565 NO: 390) HSCOC4_PEA__1_T5 (SEQ ID 536 565 NO: 391) HSCOC4_PEA__1_T7 (SEQ ID 536 565 NO: 392) HSCOC4_PEA__1_T8 (SEQ ID 536 565 NO: 393) HSCOC4_PEA__1_T11 (SEQ ID 536 565 NO: 394) HSCOC4_PEA__1_T12 (SEQ ID 536 565 NO: 395) HSCOC4_PEA__1_T14 (SEQ ID 536 565 NO: 396) HSCOC4_PEA__1_T15 (SEQ ID 536 565 NO: 397) HSCOC4_PEA__1_T20 (SEQ ID 536 565 NO: 398) HSCOC4_PEA__1_T21 (SEQ ID 536 565 NO: 399) HSCOC4_PEA__1_T25 (SEQ ID 536 565 NO: 400) HSCOC4_PEA__1_T28 (SEQ ID 536 565 NO: 401) HSCOC4_PEA__1_T30 (SEQ ID 536 565 NO: 402) HSCOC4_PEA__1_T31 (SEQ ID 536 565 NO: 403) HSCOC4_PEA__1_T32 (SEQ ID 536 565 NO: 404) HSCOC4_PEA__1_T40 (SEQ ID 536 565 NO: 405)

Segment cluster HSCOC4_PEA.sub.--1_node.sub.--8 (SEQ ID NO:435) according to the present invention is supported by 35 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 100 below describes the starting and ending position of this segment on each transcript. TABLE-US-00793 TABLE 100 Segment location on transcripts Segment Segment Transcript name starting position ending position HSCOC4_PEA__1_T1 (SEQ ID 886 966 NO: 387) HSCOC4_PEA__1_T2 (SEQ ID 886 966 NO: 388) HSCOC4_PEA__1_T3 (SEQ ID 886 966 NO: 389) HSCOC4_PEA__1_T4 (SEQ ID 886 966 NO: 390) HSCOC4_PEA__1_T5 (SEQ ID 886 966 NO: 391) HSCOC4_PEA__1_T7 (SEQ ID 886 966 NO: 392) HSCOC4_PEA__1_T8 (SEQ ID 886 966 NO: 393) HSCOC4_PEA__1_T11 (SEQ ID 886 966 NO: 394) HSCOC4_PEA__1_T12 (SEQ ID 886 966 NO: 395) HSCOC4_PEA__1_T14 (SEQ ID 886 966 NO: 396) HSCOC4_PEA__1_T15 (SEQ ID 886 966 NO: 397) HSCOC4_PEA__1_T20 (SEQ ID 886 966 NO: 398) HSCOC4_PEA__1_T21 (SEQ ID 886 966 NO: 399) HSCOC4_PEA__1_T25 (SEQ ID 886 966 NO: 400) HSCOC4_PEA__1_T28 (SEQ ID 886 966 NO: 401) HSCOC4_PEA__1_T30 (SEQ ID 886 966 NO: 402) HSCOC4_PEA__1_T31 (SEQ ID 886 966 NO: 403) HSCOC4_PEA__1_T32 (SEQ ID 886 966 NO: 404) HSCOC4_PEA__1_T40 (SEQ ID 886 966 NO: 405)

Segment cluster HSCOC4_PEA.sub.--1_node.sub.--10 (SEQ ID NO:436) according to the present invention is supported by 33 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 101 below describes the starting and ending position of this segment on each transcript. TABLE-US-00794 TABLE 101 Segment location on transcripts Segment Segment Transcript name starting position ending position HSCOC4_PEA__1_T1 (SEQ ID 967 1037 NO: 387) HSCOC4_PEA__1_T2 (SEQ ID 967 1037 NO: 388) HSCOC4_PEA__1_T3 (SEQ ID 967 1037 NO: 389) HSCOC4_PEA__1_T4 (SEQ ID 967 1037 NO: 390) HSCOC4_PEA__1_T5 (SEQ ID 967 1037 NO: 391) HSCOC4_PEA__1_T7 (SEQ ID 967 1037 NO: 392) HSCOC4_PEA__1_T8 (SEQ ID 967 1037 NO: 393) HSCOC4_PEA__1_T11 (SEQ ID 967 1037 NO: 394) HSCOC4_PEA__1_T12 (SEQ ID 967 1037 NO: 395) HSCOC4_PEA__1_T14 (SEQ ID 967 1037 NO: 396) HSCOC4_PEA__1_T15 (SEQ ID 967 1037 NO: 397) HSCOC4_PEA__1_T20 (SEQ ID 967 1037 NO: 398) HSCOC4_PEA__1_T21 (SEQ ID 967 1037 NO: 399) HSCOC4_PEA__1_T25 (SEQ ID 967 1037 NO: 400) HSCOC4_PEA__1_T28 (SEQ ID 967 1037 NO: 401) HSCOC4_PEA__1_T30 (SEQ ID 967 1037 NO: 402) HSCOC4_PEA__1_T31 (SEQ ID 967 1037 NO: 403) HSCOC4_PEA__1_T32 (SEQ ID 967 1037 NO: 404) HSCOC4_PEA__1_T40 (SEQ ID 967 1037 NO: 405)

Segment cluster HSCOC4_PEA.sub.--1_node.sub.--12 (SEQ ID NO:437) according to the present invention is supported by 33 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 102 below describes the starting and ending position of this segment on each transcript. TABLE-US-00795 TABLE 102 Segment location on transcripts Segment Segment Transcript name starting position ending position HSCOC4_PEA__

1_T1 (SEQ ID 1038 1126 NO: 387) HSCOC4_PEA_1_T2 (SEQ ID 1038 1126 NO: 388) HSCOC4_PEA_1_T3 (SEQ ID 1038 1126 NO: 389) HSCOC4_PEA_1_T4 (SEQ ID 1038 1126 NO: 390) HSCOC4_PEA_1_T5 (SEQ ID 1038 1126 NO: 391) HSCOC4_PEA_1_T7 (SEQ ID 1038 1126 NO: 392) HSCOC4_PEA_1_T8 (SEQ ID 1038 1126 NO: 393) HSCOC4_PEA_1_T11 (SEQ ID 1038 1126 NO: 394) HSCOC4_PEA_1_T12 (SEQ ID 1038 1126 NO: 395) HSCOC4_PEA_1_T14 (SEQ ID 1038 1126 NO: 396) HSCOC4_PEA_1_T15 (SEQ ID 1038 1126 NO: 397) HSCOC4_PEA_1_T20 (SEQ ID 1038 1126 NO: 398) HSCOC4_PEA_1_T21 (SEQ ID 1038 1126 NO: 399) HSCOC4_PEA_1_T25 (SEQ ID 1038 1126 NO: 400) HSCOC4_PEA_1_T28 (SEQ ID 1038 1126 NO: 401) HSCOC4_PEA_1_T30 (SEQ ID 1038 1126 NO: 402) HSCOC4_PEA_1_T31 (SEQ ID 1038 1126 NO: 403) HSCOC4_PEA_1_T32 (SEQ ID 1038 1126 NO: 404) and HSCOC4_PEA_1_T40 (SEQ ID 1038 1126 NO: 405)

Segment cluster HSCOC4_PEA.sub.--1_node.sub.--14 (SEQ ID NO:438) according to the present invention is supported by 30 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 103 below describes the starting and ending position of this segment on each transcript. TABLE-US-00796 TABLE 103 Segment location on transcripts Segment Segment Transcript name starting position ending position HSCOC4_PEA_ 1_T1 (SEQ ID 1127 1209 NO: 387) HSCOC4_PEA_1_T2 (SEQ ID 1127 1209 NO: 388) HSCOC4_PEA_1_T3 (SEQ ID 1127 1209 NO: 389) HSCOC4_PEA_1_T4 (SEQ ID 1127 1209 NO: 390) HSCOC4_PEA_1_T5 (SEQ ID 1127 1209 NO: 391) HSCOC4_PEA_1_T7 (SEQ ID 1127 1209 NO: 392) HSCOC4_PEA_1_T8 (SEQ ID 1127 1209 NO: 393) HSCOC4_PEA_1_T11 (SEQ ID 1127 1209 NO: 394) HSCOC4_PEA_1_T12 (SEQ ID 1127 1209 NO: 395) HSCOC4_PEA_1_T14 (SEQ ID 1127 1209 NO: 396) HSCOC4_PEA_1_T15 (SEQ ID 1127 1209 NO: 397) HSCOC4_PEA_1_T20 (SEQ ID 1127 1209 NO: 398) HSCOC4_PEA_1_T21 (SEQ ID 1127 1209 NO: 399) HSCOC4_PEA_1_T25 (SEQ ID 1127 1209 NO: 400) HSCOC4_PEA_1_T28 (SEQ ID 1127 1209 NO: 401) HSCOC4_PEA_1_T30 (SEQ ID 1127 1209 NO: 402) HSCOC4_PEA_1_T31 (SEQ ID 1127 1209 NO: 403) HSCOC4_PEA_1_T32 (SEQ ID 1127 1209 NO: 404) HSCOC4_PEA_1_T40 (SEQ ID 1127 1209 NO: 405)

Segment cluster HSCOC4_PEA.sub.--1_node.sub.--17 (SEQ ID NO:439) according to the present invention is supported by 28 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 104 below describes the starting and ending position of this segment on each transcript. TABLE-US-00797 TABLE 104 Segment location on transcripts Segment Segment Transcript name starting position ending position HSCOC4_PEA_ 1_T1 (SEQ ID 1210 1306 NO: 387) HSCOC4_PEA_1_T2 (SEQ ID 1210 1306 NO: 388) HSCOC4_PEA_1_T3 (SEQ ID 1210 1306 NO: 389) HSCOC4_PEA_1_T4 (SEQ ID 1210 1306 NO: 390) HSCOC4_PEA_1_T5 (SEQ ID 1210 1306 NO: 391) HSCOC4_PEA_1_T8 (SEQ ID 1210 1306 NO: 393) HSCOC4_PEA_1_T11 (SEQ ID 1210 1306 NO: 394) HSCOC4_PEA_1_T12 (SEQ ID 1210 306 NO: 395) HSCOC4_PEA_1_T14 (SEQ ID 1210 1306 NO: 396) HSCOC4_PEA_1_T15 (SEQ ID 1210 1306 NO: 397) HSCOC4_PEA_1_T20 (SEQ ID 1210 1306 NO: 398) HSCOC4_PEA_1_T21 (SEQ ID 1210 1306 NO: 399) HSCOC4_PEA_1_T25 (SEQ ID 1210 1306 NO: 400) HSCOC4_PEA_1_T28 (SEQ ID 1210 1306 NO: 401) HSCOC4_PEA_1_T30 (SEQ ID 1210 1306 NO: 402) HSCOC4_PEA_1_T31 (SEQ ID 1210 1306 NO: 403) HSCOC4_PEA_1_T32 (SEQ ID 1210 1306 NO: 404) HSCOC4_PEA_1_T40 (SEQ ID 1210 1306 NO: 405)

Segment cluster HSCOC4_PEA.sub.--1_node.sub.--19 (SEQ ID NO:440) according to the present invention is supported by 27 libraries. The number of libraries was determined as previously described. This segment can be found in the following transcript(s): HSCOC4_PEA.sub.--1_T1 (SEQ ID NO:387), HSCOC4_PEA.sub.--1.sub.--T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 105 below describes the starting and ending position of this segment on each transcript. TABLE-US-00798 TABLE 105 Segment location on transcripts Segment Segment Transcript name starting position ending position HSCOC4_PEA_ 1_T1 (SEQ ID 1307 1412 NO: 387) HSCOC4_PEA_1_T2 (SEQ ID 1307 1412 NO: 388) HSCOC4_PEA_1_T3 (SEQ ID 1307 1412 NO: 389) HSCOC4_PEA__1_T4 (SEQ ID 1307 1412 NO: 390) HSCOC4_PEA__1_T5 (SEQ ID 1307 1412 NO: 391) HSCOC4_PEA__1_T8 (SEQ ID 1307 1412 NO: 393) HSCOC4_PEA__1_T11 (SEQ ID 1307 1412 NO: 394) HSCOC4_PEA__1_T12 (SEQ ID 1307 1412 NO: 395) HSCOC4_PEA__1_T14 (SEQ ID 1307 1412 NO: 396) HSCOC4_PEA__1_T15 (SEQ ID 1307 1412 NO: 397) HSCOC4_PEA__1_T20 (SEQ ID 1307 1412 NO: 398) HSCOC4_PEA__1_T21 (SEQ ID 1307 1412 NO: 399) HSCOC4_PEA__1_T25 (SEQ ID 1307 1412 NO: 400) HSCOC4_PEA__1_T28 (SEQ ID 1307 1412 NO: 401) HSCOC4_PEA__1_T30 (SEQ ID 1307 1412 NO: 402) HSCOC4_PEA__1_T31 (SEQ ID 1307 1412 NO: 403) HSCOC4_PEA__1_T32 (SEQ ID 1307 1412 NO: 404) HSCOC4_PEA__1_T40 (SEQ ID 1307 1412 NO: 405)

Segment cluster HSCOC4_PEA.sub.--1_node.sub.--21 (SEQ ID NO:441) according to the present invention is supported by 26 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA-1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 106 below describes the starting and ending position of this segment on each transcript. TABLE-US-00799 TABLE 106 Segment location on transcripts Segment Segment Transcript name starting position ending position HSCOC4_PEA__1_T1 (SEQ ID 1413 1439 NO: 387) HSCOC4_PEA__1_T2 (SEQ ID 1413 1439 NO: 388) HSCOC4_PEA__1_T3 (SEQ ID 1413 1439 NO: 389) HSCOC4_PEA__1_T4 (SEQ ID 1413 1439 NO: 390) HSCOC4_PEA__1_T5 (SEQ ID 1413 1439 NO: 391) HSCOC4_PEA__1_T7 (SEQ ID 1210 1236 NO: 392) HSCOC4_PEA__1_T8 (SEQ ID 1413 1439 NO: 393) HSCOC4_PEA__1_T11 (SEQ ID 1413 1439 NO: 394) HSCOC4_PEA__1_T12 (SEQ ID 1413 1439 NO: 395) HSCOC4_PEA__1_T14 (SEQ ID 1413 1439 NO: 396) HSCOC4_PEA__1_T15 (SEQ ID 1413 1439 NO: 397) HSCOC4_PEA__1_T20 (SEQ ID 1413 1439 NO: 398) HSCOC4_PEA__1_T21 (SEQ ID 1413 1439 NO: 399) HSCOC4_PEA__1_T25 (SEQ ID 1413 1439 NO: 400) HSCOC4_PEA__1_T28 (SEQ ID 1413 1439 NO: 401) HSCOC4_PEA__1_T30 (SEQ ID 1413 1439 NO: 402) HSCOC4_PEA__1_T31 (SEQ ID 1413 1439 NO: 403) HSCOC4_PEA__1_T32 (SEQ ID 1413 1439 NO: 404) HSCOC4_PEA__1_T40 (SEQ ID 1413 1439 NO: 405)

Segment cluster HSCOC4_PEA.sub.--1_node.sub.--22 (SEQ ID NO:442) according to the present invention is supported by 26 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 107 below describes the starting and ending position of this segment on each transcript. TABLE-US-00800 TABLE 107 Segment location on transcripts Segment Segment Transcript name starting position ending position HSCOC4_PEA__1_T1 (SEQ ID 1440 1545 NO: 387) HSCOC4_PEA__1_T2 (SEQ ID 1440 1545 NO: 388) HSCOC4_PEA__1_T3 (SEQ ID 1440 1545 NO: 389) HSCOC4_PEA__1_T4 (SEQ ID 1440 1545 NO: 390) HSCOC4_PEA__1_T5 (SEQ ID 1440 1545 NO: 391) HSCOC4_PEA__1_T7 (SEQ ID 1237 1342 NO: 392) HSCOC4_PEA__1_T8 (SEQ ID 1440 1545 NO: 393) HSCOC4_PEA__1_T11 (SEQ ID 1440 1545 NO: 394) HSCOC4_PEA__1_T12 (SEQ ID 1440 1545 NO: 395) HSCOC4_PEA__1_T14 (SEQ ID 1440 1545 NO: 396) HSCOC4_PEA__1_T15 (SEQ ID 1440 1545 NO: 397) HSCOC4_PEA__1_T20 (SEQ ID 1440 1545 NO: 398) HSCOC4_PEA__1_T21 (SEQ ID 1440 1545 NO: 399) HSCOC4_PEA__1_T25 (SEQ ID 1440 1545 NO: 400) HSCOC4_PEA__1_T28 (SEQ ID 1440 1545 NO: 401) HSCOC4_PEA__1_T30 (SEQ ID 1440 1545 NO: 402) HSCOC4_PEA__1_T31 (SEQ ID 1440 1545 NO: 403) HSCOC4_PEA__1_T32 (SEQ ID 1440 1545 NO: 404) HSCOC4_PEA__1_T1545 NO: 405)

Segment cluster HSCOC4_PEA.sub.--1_node.sub.--28 (SEQ ID NO:443) according to the present invention is supported by 34 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 108 below describes the starting and ending position of this segment on each transcript. TABLE-US-00801 TABLE 108 Segment location on transcripts Segment Segment Transcript name starting position ending position HSCOC4_PEA__1_T1 (SEQ ID 1546 1661 NO: 387) HSCOC4_PEA__1_T2 (SEQ ID 1546 1661 NO: 388) HSCOC4_PEA__1_T3 (SEQ ID 1546 1661 NO: 389) HSCOC4_PEA__1_T4 (SEQ ID 1546 1661 NO: 390) HSCOC4_PEA__1_T5 (SEQ ID 1546 1661 NO: 391) HSCOC4_PEA__1_T7 (SEQ ID 1343 1458 NO: 392) HSCOC4_PEA__1_T8 (SEQ ID 1546 1661 NO: 393) HSCOC4_PEA__1₁₃T11 (SEQ ID 1546 1661 NO: 394) HSCOC4_PEA1₁₃ T12 (SEQ ID 1546 1661 NO: 395) HSCOC4_PEA__1_T14 (SEQ ID 1546 1661 NO: 396) HSCOC4_PEA__1_T15 (SEQ ID 1546 1661 NO: 397) HSCOC4_PEA__1_T20 (SEQ ID 1546 1661 NO: 398) HSCOC4_PEA__1_T21 (SEQ ID 1546 1661 NO: 399) HSCOC4_PEA__1_T25 (SEQ ID 1546 1661 NO: 400) HSCOC4_PEA__1_T28 (SEQ ID 1546 1661 NO: 401) HSCOC4_PEA__1_T30 (SEQ ID 1546 1661 NO: 402) HSCOC4_PEA__1_T31 (SEQ ID 1546 1661 NO: 403) HSCOC4_PEA__1_T32 (SEQ ID 1546 1661 NO: 404) HSCOC4_PEA__1_T40 (SEQ ID 1546 1661 NO: 405)

Segment cluster HSCOC4_PEA.sub.--1_node.sub.--29 (SEQ ID NO:444) according to the present invention is supported by 5 libraries. The number of libraries was determined as previously described. This segment can be found in the following transcript(s): HSCOC4_PEA.sub.--1_T5 (SEQ ID NO:391). Table 109 below describes the starting and ending position of this segment on each transcript. TABLE-US-00802 TABLE 109 Segment location on transcripts Segment Segment Transcript name starting position ending position HSCOC4_PEA__1_T5 (SEQ ID 1662 1760 NO: 391)

Segment cluster HSCOC4_PEA.sub.--1_node.sub.--41 (SEQ ID NO:445) according to the present invention is supported by 32 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 110 below describes the starting and ending position of this segment on each transcript. TABLE-US-00803 TABLE 110 Segment location on transcripts Segment Segment Transcript name starting position ending position HSCOC4_PEA__1_T1 (SEQ ID 2497 2571 NO: 387) HSCOC4_PEA__1_T2 (SEQ ID 2497 2571 NO: 388) HSCOC4_PEA__1_T3 (SEQ ID 2497 2571 NO: 389) HSCOC4_PEA__1_T4 (SEQ ID 2497 2571 NO: 390) HSCOC4_PEA__1_T5 (SEQ ID 2596 2670 NO: 391) HSCOC4_PEA__1_T7 (SEQ ID 2294 2368 NO: 392) HSCOC4_PEA__1_T8 (SEQ ID 2497 2571 NO: 393) HSCOC4_PEA__1_T11 (SEQ ID 2497 2571 NO: 394) HSCOC4_PEA__1_T12 (SEQ ID 2497 2571 NO: 395) HSCOC4_PEA__1_T14 (SEQ ID 2497 2571 NO: 396) HSCOC4_PEA__1_T15 (SEQ ID 2497 2571 NO: 397) HSCOC4_PEA__1_T20 (SEQ ID 2497 2571 NO: 398) HSCOC4_PEA__1_T21 (SEQ ID 2497 2571 NO: 399) HSCOC4_PEA__1_T25 (SEQ ID 2497 2571 NO: 400) HSCOC4_PEA__1_T28 (SEQ ID 2497 2571 NO: 401) HSCOC4_PEA__1_T30 (SEQ ID 2497 2571 NO: 402) HSCOC4_PEA__1_T31 (SEQ ID 2497 2571 NO: 403) HSCOC4_PEA__1_T32 (SEQ ID 2497 2571 NO: 404) HSCOC4_PEA__1_T40 (SEQ ID 2497 2571 NO: 405)

Segment cluster HSCOC4_PEA.sub.--1_node.sub.--45 (SEQ ID NO:446) according to the present invention is supported by 31 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 111 below describes the starting and ending position of this segment on each transcript. TABLE-US-00804 TABLE 111 Segment location on transcripts Segment Segment Transcript name starting position ending position HSCOC4_PEA__1_T1 (SEQ ID 2770 2881 NO: 387) HSCOC4_PEA__1_T2 (SEQ ID 2770 2881 NO: 388) HSCOC4_PEA__1_T3 (SEQ ID 2770 2881 NO: 389) HSCOC4_PEA__1_T4 (SEQ ID 2770 2881 NO: 390) HSCOC4_PEA__1_T5 (SEQ ID 2869 2980 NO: 391) HSCOC4__PEA__₁_T7 (SEQ ID 2567 2678 NO: 392) HSCOC4_PEA__1_T8 (SEQ ID 2770 2881 NO: 393) HSCOC4_PEA__1_T11 (SEQ ID 2770 2881 NO: 394) HSCOC4_PEA__1_T12 (SEQ ID 2770 2881 NO: 395) HSCOC4_PEA__1_T14 (SEQ ID 2770 2881 NO: 396) HSCOC4_PEA__1_T15 (SEQ ID 2770 2881 NO: 397) HSCOC4_PEA__1_T20 (SEQ ID 2770 2881 NO: 398) HSCOC4_PEA__1_T21 (SEQ ID 2770 2881 NO: 399) HSCOC4_PEA__1_T25 (SEQ ID 2770 2881 NO: 400) HSCOC4_PEA__1_T28 (SEQ ID 2770 2881 NO: 401) HSCOC4_PEA__1_T30 (SEQ ID 2770 2881 NO: 402) HSCOC4_PEA__1_T31 (SEQ ID 2770 2881 NO: 403) HSCOC4_PEA__1_T32 (SEQ ID 2770 2881 NO: 404) HSCOC4_PEA__1_T40 (SEQ ID 2770 2881 NO: 405)

Segment cluster HSCOC4_PEA.sub.--1_node.sub.--47 (SEQ ID NO:447) according to the present invention is supported by 32 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 112 below describes the starting and ending position of this segment on each transcript. TABLE-US-00805 TABLE 112 Segment location on transcripts Segment Segment Transcript name starting position ending position HSCOC4_PEA_1_T1 (SEQ ID 2882 2952 NO: 387) HSCOC4_PEA_1_T2 (SEQ ID 2882 2952 NO: 388) HSCOC4_PEA_1_T3 (SEQ ID 2882 2952 NO: 389) HSCOC4_PEA_1_T4 (SEQ ID 2882 2952 NO: 390) HSCOC4_PEA_1_T5 (SEQ ID 2981 3051 NO: 391) HSCOC4_PEA_1_T7 (SEQ ID 2679 2749 NO: 392) HSCOC4_PEA_1_T8 (SEQ ID 2882 2952 NO: 393) HSCOC4_PEA_1_T11 (SEQ ID 2882 2952 NO: 394) HSCOC4_PEA_1_T12 (SEQ ID 2882 2952 NO: 395) HSCOC4_PEA_1_T14 (SEQ ID 2882 2952 NO: 396) HSCOC4_PEA_1_T15 (SEQ ID 2882 2952 NO: 397) HSCOC4_PEA_1_T20 (SEQ ID 2882 2952 NO: 398) HSCOC4_PEA_1_T21 (SEQ ID 2882 2952 NO: 399) HSCOC4_PEA_1_T25 (SEQ ID 2882 2952 NO: 400) HSCOC4_PEA_1_T28 (SEQ ID 2882 2952 NO: 401) HSCOC4_PEA_1_T30 (SEQ ID 2882 2952 NO: 402) HSCOC4_PEA_1_T31 (SEQ ID 2882 2952 NO: 403) HSCOC4_PEA_1_T32 (SEQ ID 2882 2952 NO: 404) HSCOC4_PEA_1_T40 (SEQ ID 2882 2952 NO: 405)

Segment cluster HSCOC4_PEA.sub.--1_node.sub.--50 (SEQ ID NO:448) according to the present invention is supported by 5 libraries. The number of libraries was determined as previously described. This segment can be found in the following transcript(s): HSCOC4_PEA.sub.--1_T1 (SEQ ID NO:387) and HSCOC4_PEA.sub.--1_T3 (SEQ ID NO:389). Table 113 below describes the starting and ending position of this segment on each transcript. TABLE-US-00806 TABLE 113 Segment location on transcripts Segment Segment Transcript name starting position ending position HSCOC4_PEA_1_T1 (SEQ ID 3093 3205 NO: 387) HSCOC4_PEA_1_T3 (SEQ ID 3351 3463 NO: 389)

Segment cluster HSCOC4_PEA.sub.--1_node.sub.--53 (SEQ ID NO:449) according to the present invention is supported by 38 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 114 below describes the starting and ending position of this segment on each transcript. TABLE-US-00807 TABLE 114 Segment location on transcripts Segment Segment Transcript name starting position ending position HSCOC4_PEA_1_T1 (SEQ ID 3416 3467 NO: 387) HSCOC4_PEA_1_T2 (SEQ ID 3561 3612 NO: 388) HSCOC4_PEA_1_T3 (SEQ ID 3674 3725 NO: 389) HSCOC4_PEA_1_T4 (SEQ ID 3303 3354 NO: 390) HSCOC4_PEA_1_T5 (SEQ ID 3402 3453 NO: 391) HSCOC4_PEA_1_T7 (SEQ ID 3100 3151 NO: 392) HSCOC4_PEA_1_T8 (SEQ ID 3303 3354 NO: 393) HSCOC4_PEA_1_T11 (SEQ ID 3303 3354 NO: 394) HSCOC4_PEA_1_T12 (SEQ ID 3303 3354 NO: 395) HSCOC4_PEA_1_T14 (SEQ ID 3303 3354 NO: 396) HSCOC4_PEA_1_T15 (SEQ ID 3303 3354 NO: 397) HSCOC4_PEA_1_T20 (SEQ ID 3303 3354 NO: 398) HSCOC4_PEA_1_T21 (SEQ ID 3303 3354 NO: 399) HSCOC4_PEA_1_T25 (SEQ ID 3303 3354 NO: 400) HSCOC4_PEA_1_T28 (SEQ ID 3303 3354 NO: 401) HSCOC4_PEA_1_T30 (SEQ ID 3303 3354 NO: 402) HSCOC4_PEA_1_T31 (SEQ ID 3303 3354 NO: 403) HSCOC4_PEA_1_T32 (SEQ ID 3303 3354 NO: 404) HSCOC4_PEA_1_T40 (SEQ ID 3303 3354 NO: 405)

Segment cluster HSCOC4_PEA.sub.--1_node.sub.--55 (SEQ ID NO:450) according to the present invention is supported by 40 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 115 below describes the starting and ending position of this segment on each transcript. TABLE-US-00808 TABLE 115 Segment location on transcripts Segment Segment Transcript name starting position ending position HSCOC4_PEA_1_T1 (SEQ ID 3468 3557 NO: 387) HSCOC4_PEA_1_T2 (SEQ ID 3613 3702 NO: 388) HSCOC4_PEA_1_T3 (SEQ ID 3726 3815 NO: 389) HSCOC4_PEA_1_T4 (SEQ ID 3355 3444 NO: 390) HSCOC4_PEA_1_T5 (SEQ ID 3454 3543 NO: 391) HSCOC4_PEA_1_T7 (SEQ ID 3152 3241 NO: 392) HSCOC4_PEA_1_T8 (SEQ ID 3355 3444 NO: 393) HSCOC4_PEA_1_T11 (SEQ ID 3355 3444 NO: 394) HSCOC4_PEA_1_T12 (SEQ ID 3355 3444 NO: 395) HSCOC4_PEA_1_T14 (SEQ ID 3355 3444 NO: 396) HSCOC4_PEA_1_T15 (SEQ ID 3355 3444 NO: 397) HSCOC4_PEA_1_T20 (SEQ ID 3355 3444 NO: 398) HSCOC4_PEA_1_T21 (SEQ ID 3355 3444 NO: 399) HSCOC4_PEA_1_T25 (SEQ ID 3355 3444 NO: 400) HSCOC4_PEA_1_T28 (SEQ ID 3355 3444 NO: 401) HSCOC4_PEA_1_T30 (SEQ ID 3355 3444 NO: 402) HSCOC4_PEA_1_T31 (SEQ ID 3355 3444 NO: 403) HSCOC4_PEA_1_T32 (SEQ ID 3355 3444 NO: 404) HSCOC4_PEA_1_T40 (SEQ ID 3355 3444 NO: 405)

Segment cluster HSCOC4_PEA.sub.--1_node.sub.--57 (SEQ ID NO:451) according to the present invention is supported by 42 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 116 below describes the starting and ending position of this segment on each transcript. TABLE-US-00809 TABLE 116 Segment location on transcripts Segment Segment Transcript name starting position ending position HSCOC4_PEA__1_T1 (SEQ ID 3558 3604 NO: 387) HSCOC4_PEA__1_T2 (SEQ ID 3703 3749 NO: 388) HSCOC4_PEA__1_T3 (SEQ ID 3816 3862 NO: 389) HSCOC4_PEA__1_T4 (SEQ ID 3445 3491 NO: 390) HSCOC4_PEA__1_T5 (SEQ ID 3544 3590 NO: 391) HSCOC4_PEA__1_T7 (SEQ ID 3242 3288 NO: 392) HSCOC4_PEA__1_T8 (SEQ ID 3445 3491 NO: 393) HSCOC4_PEA__1_T11 (SEQ ID 3445 3491 NO: 394) HSCOC__4_PEA__1_T12 (SEQ ID 3445 3491 NO: 395) HSCOC4_PEA__1_T14 (SEQ ID 3445 3491 NO: 396) HSCOC4_PEA__1_T15 (SEQ ID 3445 3491 NO: 397) HSCOC4_PEA__1_T20 (SEQ ID 3445 3491 NO: 398) HSCOC4_PEA__1_T21 (SEQ ID 3445 3491 NO: 399) HSCOC4_PEA__1_T25 (SEQ ID 3445 3491 NO: 400) HSCOC4_PEA__1_T28 (SEQ ID 3445 3491 NO: 401) HSCOC4_PEA__1_T30 (SEQ ID 3445 3491 NO: 402) HSCOC4_PEA__1_T31 (SEQ ID 3445 3491 NO: 403) HSCOC4_PEA__1_T32 (SEQ ID 3445 3491 NO: 404) HSCOC4_PEA__1_T40 (SEQ ID 3445 3491 NO: 405)

Segment cluster HSCOC4_PEA.sub.--1-node.sub.--60 (SEQ ID NO:452) according to the present invention is supported by 50 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 117 below describes the starting and ending position of this segment on each transcript. TABLE-US-00810 TABLE 117 Segment location on transcripts Segment Segment Transcript name starting position ending position HSCOC4_PEA__1_T1 (SEQ ID 3768 3843 NO: 387) HSCOC4_PEA__1_T2 (SEQ ID 3913 3988 NO: 388) HSCOC4_PEA__1_T3 (SEQ ID 4026 4101 NO: 389) HSCOC4_PEA__1_T4 (SEQ ID 3834 3909 NO: 390) HSCOC4_PEA__1_T5 (SEQ ID 3754 3829 NO: 391) HSCOC4_PEA__1_T7 (SEQ ID 3452 3527 NO: 392) HSCOC4_PEA__1_T8 (SEQ ID 3655 3730 NO: 393) HSCOC4_PEA__1_T11 (SEQ ID 3655 3730 NO: 394) HSCOC4_PEA__1_T12 (SEQ ID 3655 3730 NO: 395) HSCOC4_PEA__1_T14 (SEQ ID 3655 3730 NO: 396) HSCOC4_PEA__1_T15 (SEQ ID 3655 3730 NO: 397) HSCOC4_PEA__1_T20 (SEQ ID 3655 3730 NO: 398) HSCOC4_PEA__1_T21 (SEQ ID 3655 3730 NO: 399) HSCOC4_PEA__1_T25 (SEQ ID 3655 3730 NO: 400) HSCOC4_PEA__1_T28 (SEQ ID 3655 3730 NO: 401) HSCOC4_PEA__1_T30 (SEQ ID 3655 3730 NO: 402) HSCOC4_PEA__1_T31 (SEQ ID 3655 3730 NO: 403) HSCOC4_PEA__1_T32 (SEQ ID 3655 3730 NO: 404) HSCOC4_PEA__1_T40 (SEQ ID 3655 3730 NO: 405)

Segment cluster HSCOC4_PEA.sub.--1_node.sub.--64 (SEQ ID NO:453) according to the present invention is supported by 65 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 118 below describes the starting and ending position of this segment on each transcript. TABLE-US-00811 TABLE 118 Segment location on transcripts Segment Segment Transcript name starting position ending position HSCOC4_PEA__1_T1 (SEQ ID 4001 4117 NO: 387) HSCOC4_PEA__1_T2 (SEQ ID 4146 4262 NO: 388) HSCOC4_PEA__1_T3 (SEQ ID 4259 4375 NO: 389) HSCOC4_PEA__1_T4 (SEQ ID 4067 4183 NO: 390) HSCOC4_PEA__1_T5 (SEQ ID 3987 4103 NO: 391) HSCOC4__PEA_1_T7 (SEQ ID 3685 3801 NO: 392) HSCOC4_PEA__1_T8 (SEQ ID 3888 4004 NO: 393) HSCOC4_PEA__1_T11 (SEQ ID 3888 4004 NO: 394) HSCOC4_PEA__1_T12 (SEQ ID 3888 4004 NO: 395) HSCOC4_PEA__1_T14 (SEQ ID 3888 4004 NO: 396) HSCOC4_PEA__1_T15 (SEQ ID 3888 4004 NO: 397) HSCOC4_PEA__1_T20 (SEQ ID 3888 4004 NO: 398) HSCOC4_PEA__1_T21 (SEQ ID 3888 4004 NO: 399) HSCOC4_PEA__1_T25 (SEQ ID 3888 4004 NO: 400) HSCOC4_PEA__1_T28 (SEQ ID 3888 4004 NO: 401) HSCOC4_PEA__1_T30 (SEQ ID 3888 4004 NO: 402) HSCOC4_PEA__1_T31 (SEQ ID 3888 4004 NO: 403) HSCOC4_PEA__1_T32 (SEQ ID 3888 4004 NO: 404) HSCOC4_PEA__1_T40 (SEQ ID 3888 4004 NO: 405)

Segment cluster HSCOC4_PEA.sub.--1_node.sub.--69 (SEQ ID NO:454) according to the present invention can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 119 below describes the starting and ending position of this segment on each transcript. TABLE-US-00812 TABLE 119 Segment location on transcripts Segment Segment Transcript name starting position ending position HSCOC4_PEA_1_T1 (SEQ ID 4290 4309 NO: 387) HSCOC4_PEA_1_T2 (SEQ ID 4435 4454 NO: 388). HSCOC4_PEA_1_T3 (SEQ ID 4548 4567 NO: 389) HSCOC4_PEA_1_T4 (SEQ ID 4356 4375 NO: 390) HSCOC4_PEA_1_T5 (SEQ ID 4276 4295 NO: 391) HSCOC4_PEA_1_T7 (SEQ ID 3974 3993 NO: 392) HSCOC4_PEA_1_T8 (SEQ ID 4177 4196 NO: 393) HSCOC4_PEA_1_T11 (SEQ ID 4177 4196 NO: 394) HSCOC4_PEA_1_T12 (SEQ ID 4177 4196 NO: 395) HSCOC4_PEA_1_T14 (SEQ ID 4177 4196 NO: 396) HSCOC4_PEA_1_T15 (SEQ ID 4177 4196 NO: 397) HSCOC4_PEA_1_T20 (SEQ ID 4177 4196 NO: 398) HSCOC4_PEA_1_T21 (SEQ ID 4177 4196 NO: 399) HSCOC4_PEA_1_T25 (SEQ ID 4177 4196 NO: 400) HSCOC4_PEA_1_T28 (SEQ ID 4177 4196 NO: 401) HSCOC4_PEA_1_T30 (SEQ ID 4177 4196 NO: 402) HSCOC4_PEA_1_T31 (SEQ ID 4177 4196 NO: 403) HSCOC4_PEA_1_T32 (SEQ ID 4177 4196 NO: 404) HSCOC4_PEA_1_T40 (SEQ ID 4177 4196 NO: 405)

Segment cluster HSCOC4_PEA.sub.--1_node.sub.--70 (SEQ ID NO:455) according to the present invention is supported by 58 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 120 below describes the starting and ending position of this segment on each transcript. TABLE-US-00813 TABLE 120 Segment location on transcripts Segment Segment Transcript name starting position ending position HSCOC4_PEA_1_T1 (SEQ ID 4310 4349 NO: 387) HSCOC4_PEA_1_T2 (SEQ ID 4455 4494 NO: 388) HSCOC4_PEA_1_T3 (SEQ ID 4568 4607 NO: 389) HSCOC4_PEA_1_T4 (SEQ ID 4376 4415 NO: 390) HSCOC4_PEA_1_T5 (SEQ ID 4296 4335 NO: 391) HSCOC4_PEA_1_T7 (SEQ ID 3994 4033 NO: 392) HSCOC4_PEA_1_T8 (SEQ ID 4197 4236 NO: 393) HSCOC4_PEA_1_T11 (SEQ ID 4197 4236 NO: 394) HSCOC4_PEA_1_T12 (SEQ ID 4197 4236 NO: 395) HSCOC4_PEA_1_T14 (SEQ ID 4197 4236 NO: 396) HSCOC4_PEA_1_T15 (SEQ ID 4197 4236 NO: 397) HSCOC4_PEA_1_T20 (SEQ ID 4197 4236 NO: 398) HSCOC4_PEA_1_T21 (SEQ ID 4197 4236 NO: 399) HSCOC4_PEA_1_T25 (SEQ ID 4197 4236 NO: 400) HSCOC4_PEA_1_T28 (SEQ ID 4197 4236 NO: 401) HSCOC4_PEA_1_T30 (SEQ ID 4197 4236 NO: 402) HSCOC4_PEA_1_T31 (SEQ ID 4197 4236 NO: 403) HSCOC4_PEA_1_T32 (SEQ ID 4197 4236 NO: 404)

Segment cluster HSCOC4_PEA.sub.--1_node.sub.--71 (SEQ ID NO:456) according to the present invention is supported by 58 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 121 below describes the starting and ending position of this segment on each transcript. TABLE-US-00814 TABLE 121 Segment location on transcripts Segment Segment Transcript name starting position ending position HSCOC4_PEA_1_T1 (SEQ ID 4350 4391 NO: 387) HSCOC4_PEA_1_T2 (SEQ ID 4495 4536 NO: 388) HSCOC4_PEA_1_T3 (SEQ ID 4608 4649 NO: 389) HSCOC4_PEA_1_T4 (SEQ ID 4416 4457 NO: 390) HSCOC4_PEA_1_T5 (SEQ ID 4336 4377 NO: 391) HSCOC4_PEA_1_T7 (SEQ ID 4034 4075 NO: 392) HSCOC4_PEA_1_T8 (SEQ ID 4237 4278 NO: 393) HSCOC4_PEA_1_T11 (SEQ ID 4237 4278 NO: 394) HSCOC4_PEA_1_T12 (SEQ ID 4237 4278 NO: 395) HSCOC4_PEA_1_T14 (SEQ ID 4237 4278 NO: 396) HSCOC4_PEA_1_T15 (SEQ ID 4237 4278 NO: 397) HSCOC4_PEA_1_T20 (SEQ ID 4237 4278 NO: 398) HSCOC4_PEA_1_T21 (SEQ ID 4237 4278 NO: 399) HSCOC4_PEA_1_T25 (SEQ ID 4237 4278 NO: 400) HSCOC4_PEA_1_T28 (SEQ ID 4237 4278 NO: 401) HSCOC4_PEA_1_T30 (SEQ ID 4237 4278 NO: 402) HSCOC4_PEA_1_T31 (SEQ ID 4237 4278 NO: 403) HSCOC4_PEA_1_T32 (SEQ ID 4237 4278 NO: 404)

Segment cluster HSCOC4_PEA.sub.--1_node.sub.--73 (SEQ ID NO:457) according to the present invention is supported by 1 libraries. The number of libraries was determined as previously described. This segment can be found in the following transcript(s): HSCOC4_PEA.sub.--1_T20 (SEQ ID NO:398). Table 122 below describes the starting and ending position of this segment on each transcript. TABLE-US-00815 TABLE 122 Segment location on transcripts Segment Segment Transcript name starting position ending position HSCOC4_PEA__1_T20 (SEQ ID 4410 4491 NO: 398)

Segment cluster HSCOC4_PEA.sub.--1_node.sub.--74 (SEQ ID NO:458) according to the present invention can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 123 below describes the starting and ending position of this segment on each transcript. TABLE-US-00816 TABLE 123 Segment location on transcripts Segment Segment Transcript name starting position ending position HSCOC4_PEA__1_T1 (SEQ ID 4523 4546 NO: 387) HSCOC4_PEA__1_T2 (SEQ ID 4668 4691 NO: 388) HSCOC4_PEA__1_T3 (SEQ ID 4781 4804 NO: 389) HSCOC4_PEA__1_T4 (SEQ ID 4589 4612 NO: 390) HSCOC4_PEA__1_T5 (SEQ ID 4509 4532 NO: 391) HSCOC4_PEA__1_T7 (SEQ ID 4207 4230 NO: 392) HSCOC4_PEA__1_T8 (SEQ ID 4410 4433 NO: 393) HSCOC4_PEA__1_T11 (SEQ ID 4410 4433 NO: 394) HSCOC4_PEA__1_T12 (SEQ ID 4410 4433 NO: 395) HSCOC4_PEA__1_T14 (SEQ ID 4410 4433 NO: 396) HSCOC4_PEA__1_T15 (SEQ ID 4410 4433 NO: 397) HSCOC4_PEA__1_T20 (SEQ ID 4492 4515 NO: 398) HSCOC4_PEA__1_T21 (SEQ ID 4410 4433 NO: 399) HSCOC4_PEA__1_T25 (SEQ ID 4410 4433 NO: 400) HSCOC4_PEA__1_T28 (SEQ ID 4410 4433 NO: 401) HSCOC4_PEA__1_T30 (SEQ ID 4410 4433 NO: 402) HSCOC4_PEA__1_T31 (SEQ ID 4410 4433 NO: 403) HSCOC4_PEA__1_T32 (SEQ ID 4410 4433 NO: 404)

Segment cluster HSCOC4_PEA.sub.--1_node.sub.--75 (SEQ ID NO:459) according to the present invention is supported by 65 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 124 below describes the starting and ending position of this segment on each transcript. TABLE-US-00817 TABLE 124 Segment location on transcripts Segment Segment Transcript name starting position ending position HSCOC4_PEA__1_T1 (SEQ ID 4547 4626 NO: 387) HSCOC4_PEA__1_T2 (SEQ ID 4692 4771 NO: 388) HSCOC4_PEA__1_T3 (SEQ ID 4805 4884 NO: 389) HSCOC4_PEA__1_T4 (SEQ ID 4613 4692 NO: 390) HSCOC4_PEA__1_T5 (SEQ ID 4533 4612 NO: 391) HSCOC4_PEA__1_T7 (SEQ ID 4231 4310 NO: 392) HSCOC4_PEA__1_T8 (SEQ ID 4434 4513 NO: 393) HSCOC4_PEA__1_T11 (SEQ ID 4434 4513 NO: 394) HSCOC4_PEA_1_T12 (SEQ ID 4434 4513 NO: 395) HSCOC4_PEA_1_T14 (SEQ ID 4434 4513 NO: 396) HSCOC4_PEA_1_T15 (SEQ ID 4434 4513 NO: 397) HSCOC4_PEA_1_T20 (SEQ ID 4516 4595 NO: 398) HSCOC4_PEA_1_T21 (SEQ ID 4434 4513 NO: 399) HSCOC4_PEA_1_T25 (SEQ ID 4434 4513 NO: 400) HSCOC4_PEA_1_T28 (SEQ ID 4434 4513 NO: 401) HSCOC4_PEA_1_T30 (SEQ ID 4434 4513 NO: 402) HSCOC$_4$_PEA_1_T31 (SEQ ID 4434 4513 NO: 403) HSCOC4_PEA_1_T32 (SEQ ID 4434 4513 NO: 404)

Segment cluster HSCOC4_PEA.sub.--1_node.sub.--76 (SEQ ID NO:460) according to the present invention is supported by 66 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 125 below describes the starting and ending position of this segment on each transcript. TABLE-US-00818 TABLE 125 Segment location on transcripts Segment Segment Transcript name starting position ending position HSCOC4_PEA__1_T1 (SEQ ID 4627 4690 NO: 387) HSCOC4_PEA__1_T2 (SEQ ID 4772 4835 NO: 388) HSCOC4_PEA__1_T3 (SEQ ID 4885 4948 NO: 389) HSCOC4_PEA__1_T4 (SEQ ID 4693 4756 NO: 390) HSCOC4_PEA__1_T5 (SEQ ID 4613 4676 NO: 391) HSCOC4_PEA__1_T7 (SEQ ID 4311 4374 NO: 392) HSCOC4_PEA__1_T8 (SEQ ID 4514 4577 NO: 393) HSCOC4_PEA__1_T11 (SEQ ID 4514 4577 NO: 394) HSCOC4_PEA__1_T12 (SEQ ID 4514 4577 NO: 395) HSCOC4_PEA__1_T14 (SEQ ID 4514 4577 NO: 396) HSCOC4_PEA__1_T15 (SEQ ID 4514 4577 NO: 397) HSCOC4_PEA__1_T20 (SEQ ID 4596 4659 NO: 398) HSCOC4_PEA__1_T21 (SEQ ID 4514 4577 NO: 399) HSCOC4_PEA__1_T25 (SEQ ID 4514 4577 NO: 400) HSCOC4_PEA__1_T28 (SEQ ID 4514 4577 NO: 401) HSCOC4_PEA__1_T30 (SEQ ID 4514 4577 NO: 402) HSCOC4_PEA__1_T31 (SEQ ID 4514 4577 NO: 403) HSCOC4_PEA__1_T32 (SEQ ID 4514 4577 NO: 404)

Segment cluster HSCOC4_PEA.sub.--1_node.sub.--78 (SEQ ID NO:461) according to the present invention is supported by 71 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 126 below describes the starting and ending position of this segment on each transcript. TABLE-US-00819 TABLE 126 Segment location on transcripts Segment Segment Transcript name starting position ending position HSCOC4_PEA_1_T1 (SEQ ID 4691 4750 NO: 387) HSCOC4_PEA_1_T2 (SEQ ID 4836 4895 NO: 388) HSCOC4_PEA_1_T3 (SEQ ID 4949 5008 NO: 389) HSCOC4_PEA_1_T4 (SEQ ID 4757 4816 NO: 390) HSCOC4_PEA_1_T5 (SEQ ID 4677 4736 NO: 391) HSCOC4_PEA_1_T7 (SEQ ID 4375 4434 NO: 392) HSCOC4_PEA_1_T8 (SEQ ID 4578 4637 NO: 393) HSCOC4_PEA_1_T11 (SEQ ID 4578 4637 NO: 394) HSCOC4_PEA_1_T12 (SEQ ID 4578 4637 NO: 395) HSCOC4_PEA_1_T14 (SEQ ID 4971 5030 NO: 396) HSCOC4_PEA_1_T15 (SEQ ID 4578 4637 NO: 397) HSCOC4_PEA_1_T20 (SEQ ID 5053 5112 NO: 398) HSCOC4_PEA_1_T21 (SEQ ID 4578 4637 NO: 399) HSCOC4_PEA_1_T25 (SEQ ID 4578 4637 NO: 400) HSCOC4_PEA_1_T28 (SEQ ID 4578 4637 NO: 401) HSCOC4_PEA_1_T30 (SEQ ID 4578 4637 NO: 402) HSCOC4_PEA_1_T31 (SEQ ID 4578 4637 NO: 403) HSCOC4_PEA_1_T32 (SEQ ID 4578 4637 NO: 404)

Segment cluster HSCOC4_PEA.sub.--1_node.sub.--80 (SEQ ID NO:462) according to the present invention is supported by 75 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA-1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15(SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 127 below describes the starting and ending position of this segment on each transcript. TABLE-US-00820 TABLE 127 Segment location on transcripts Segment Segment Transcript name starting position ending position HSCOC4_PEA_1_T1 (SEQ ID 4751 4844 NO: 387) HSCOC4_PEA_1_T2 (SEQ ID 4896 4989 NO: 388) HSCOC4_PEA_1_T3 (SEQ ID 5009 5102 NO: 389) HSCOC4_PEA_1_T4 (SEQ ID 4817 4910 NO: 390) HSCOC4_PEA_1_T5 (SEQ ID 4737 4830 NO: 391) HSCOC4_PEA_1_T7 (SEQ ID 4435 4528 NO: 392) HSCOC4_PEA_1_T8 (SEQ ID 4638 4731 NO: 393) HSCOC4_PEA_1_T11 (SEQ ID 5687 5780 NO: 394) HSCOC4_PEA_1_T12 (SEQ ID 4638 4731 NO: 395) HSCOC4_PEA_1_T14 (SEQ ID 5031 5124 NO: 396) HSCOC4_PEA_1_T15 (SEQ ID 4638 4731 NO: 397) HSCOC4_PEA_1_T20 (SEQ ID 5113 5206 NO: 398) HSCOC4_PEA_1_T21 (SEQ ID 4638 4731 NO: 399) HSCOC4_PEA_1_T25 (SEQ ID 4638 4731 NO: 400) HSCOC4_PEA_1_T28 (SEQ ID 4638 4731 NO: 401) HSCOC4_PEA_1_T30 (SEQ ID 4638 4731 NO: 402) HSCOC4_PEA_1_T31 (SEQ ID 4638 4731 NO: 403) HSCOC4_PEA_1_T32 (SEQ ID 4638 4731 NO: 404)

Segment cluster HSCOC4_PEA.sub.--1_node.sub.--82 (SEQ ID NO:463) according to the present invention can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 128 below describes the starting and ending position of this segment on each transcript. TABLE-US-00821 TABLE 128 Segment location on transcripts Segment Segment Transcript name starting position ending position HSCOC4_PEA_1_T1 (SEQ ID 4845 4855 NO: 387) HSCOC4_PEA_1_T2 (SEQ ID 4990 5000 NO: 388) HSCOC4_PEA_1_T3 (SEQ ID 5103 5113 NO: 389) HSCOC4_PEA_1_T4 (SEQ ID 4911 4921 NO: 390) HSCOC4_PEA_1_T5 (SEQ ID 4831 4841 NO: 391) HSCOC_4_PEA_1_T7 (SEQ ID 4529 4539 NO: 392) HSCOC4_PEA_1_T8 (SEQ ID 4732 4742 NO: 393) HSCOC4_PEA_1_T11 (SEQ ID 5781 5791 NO: 394) HSCOC4_PEA_1_T12 (SEQ ID 4732 4742 NO: 395) HSCOC4_PEA_1_T14 (SEQ ID 5125 5135 NO: 396) HSCOC4_PEA_1_T15 (SEQ ID 4732 4742 NO: 397) HSCOC4_PEA_1_T20 (SEQ ID 5207 5217 NO: 398) HSCOC4_PEA_1_T21 (SEQ ID 4732 4742 NO: 399) HSCOC4_PEA_1_T25 (SEQ ID 4732 4742 NO: 400) HSCOC4_PEA_1_T28 (SEQ ID 4732 4742 NO: 401) HSCOC4_PEA_1_T30 (SEQ ID 4732 4742 NO: 402) HSCOC4_PEA_1_T31 (SEQ ID 4732 4742 NO: 403) HSCOC4_PEA_1_T32 (SEQ ID 4732 4742 NO: 404)

Segment cluster HSCOC4_PEA.sub.--1_node.sub.--83 (SEQ ID NO:464) according to the present invention is supported by 77 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393),
HSCOC4_PEA.sub.--1_T11 (SEQ ID NO:394),
HSCOC4_PEA.sub.--1_T12 (SEQ ID NO:395),
HSCOC4_PEA.sub.--1_T14 (SEQ ID NO:396),
HSCOC4_PEA.sub.--1_T15 (SEQ ID NO:397),
HSCOC4_PEA.sub.--1_T20 (SEQ ID NO:398),
HSCOC4_PEA.sub.--1_T21 (SEQ ID NO:399),
HSCOC4_PEA.sub.--1_T25 (SEQ ID NO:400),
HSCOC4_PEA.sub.--1_T28 (SEQ ID NO:401),
HSCOC4_PEA.sub.--1_T30 (SEQ ID NO:402),
HSCOC4_PEA.sub.--1_T31 (SEQ ID NO:403) and
HSCOC4_PEA.sub.--1_T32 (SEQ ID NO:404). Table 129 below describes the starting and ending position of this segment on each transcript. TABLE-US-00822 TABLE 129 Segment location on transcripts Segment Segment Transcript name starting position ending position HSCOC4_PEA__1_T1 (SEQ ID 4856 4971 NO: 387) HSCOC4_PEA__1_T2 (SEQ ID 5001 5116 NO: 388) HSCOC4_PEA__1_T3 (SEQ ID 5114 5229 NO: 389) HSCOC4_PEA__1_T4 (SEQ ID 4922 5037 NO: 390) HSCOC4_PEA__1_T5 (SEQ ID 4842 4957 NO: 391) HSCOC4_PEA__1_T7 (SEQ ID 4540 4655 NO: 392) HSCOC4_PEA__1_T8 (SEQ ID 4743 4858 NO: 393) HSCOC4_PEA__1_T11 (SEQ ID 5792 5907 NO: 394) HSCOC4_PEA__1_T12 (SEQ ID 4743 4858 NO: 395) HSCOC4_PEA__1_T14 (SEQ ID 5136 5251 NO: 396) HSCOC4_PEA__1_T15 (SEQ ID 4743 4858 NO: 397) HSCOC4_PEA__1_T20 (SEQ ID 5218 5333 NO: 398) HSCOC4_PEA__1_T21 (SEQ ID 4743 4858 NO: 399) HSCOC4_PEA__1_T25 (SEQ ID 4743 4858 NO: 400) HSCOC4_PEA__1_T28 (SEQ ID 4743 4858 NO: 401) HSCOC4_PEA__1_T30 (SEQ ID 4743 4858 NO: 402) HSCOC4_PEA__1_T31 (SEQ ID 4743 4858 NO: 403) HSCOC4_PEA__1_T32 (SEQ ID 4743 4858 NO: 404)

Segment cluster HSCOC4_PEA.sub.--1_node.sub.--84 (SEQ ID NO:465) according to the present invention can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389),
HSCOC4_PEA.sub.--1_T4 (SEQ ID NO:390),
HSCOC4_PEA.sub.--1_T5 (SEQ ID NO:391),
HSCOC4_PEA.sub.--1_T7 (SEQ ID NO:392),
HSCOC4_PEA.sub.--1_T8 (SEQ ID NO:393),
HSCOC4_PEA.sub.--1_T11 (SEQ ID NO:394),
HSCOC4_PEA.sub.--1_T12 (SEQ ID NO:395),
HSCOC4_PEA.sub.--1_T14 (SEQ ID NO:396),
HSCOC4_PEA.sub.--1_T15 (SEQ ID NO:397),
HSCOC4_PEA.sub.--1_T20 (SEQ ID NO:398),
HSCOC4_PEA.sub.--1_T21 (SEQ ID NO:399),
HSCOC4_PEA.sub.--1_T25 (SEQ ID NO:400),
HSCOC4_PEA.sub.--1_T28 (SEQ ID NO:401),
HSCOC4_PEA.sub.--1_T30 (SEQ ID NO:402),
HSCOC4_PEA.sub.--1_T31 (SEQ ID NO:403) and
HSCOC4_PEA.sub.--1_T32 (SEQ ID NO:404). Table 130 below describes the starting and ending position of this segment on each transcript. TABLE-US-00823 TABLE 130 Segment location on transcripts Segment Segment Transcript name starting position ending position HSCOC4_PEA__1_T1 (SEQ ID 4972 4984 NO: 387) HSCOC4_PEA__1_T2 (SEQ ID 5117 5129 NO: 388) HSCOC4_PEA__1_T3 (SEQ ID 5230 5242 NO: 389) HSCOC4_PEA__1_T4 (SEQ ID 5038 5050 NO: 390) HSCOC4_PEA__1_T5 (SEQ ID 4958 4970 NO: 391) HSCOC4_PEA.sub.b 1_T7 (SEQ ID 4656 4668 NO: 392) HSCOC4_PEA__1_T8 (SEQ ID 4859 4871 NO: 393) HSCOC4_PEA__1_T11 (SEQ ID 5908 5920 NO: 394) HSCOC4_PEA__1_T12 (SEQ ID 4859 4871 NO: 395) HSCOC4_PEA__1_T14 (SEQ ID 5252 5264 NO: 396) HSCOC4_PEA__1_T15 (SEQ ID 4859 4871 NO: 397) HSCOC4_PEA__1_T20 (SEQ ID 5334 5346 NO: 398) HSCOC4_PEA__1_T21 (SEQ ID 4859 4871 NO: 399) HSCOC4_PEA__1_T25 (SEQ ID 4859 4871 NO: 400) HSCOC4_PEA__1_T28 (SEQ ID 4859 4871 NO: 401) HSCOC4_PEA__1_T30 (SEQ ID 4859 4871 NO: 402) HSCOC4_PEA__1_T31 (SEQ ID 4859 4871 NO: 403) HSCOC4_PEA__1_T32 (SEQ ID 4859 4871 NO: 404)

Segment cluster HSCOC4_PEA.sub.--1_node.sub.--85 (SEQ ID NO:466) according to the present invention is supported by 68 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388),
HSCOC4_PEA.sub.--1_T3 (SEQ ID NO:389),
HSCOC4_PEA.sub.--1_T4 (SEQ ID NO:390),
HSCOC4_PEA.sub.--1_T5 (SEQ ID NO:391),
HSCOC4_PEA.sub.--1_T7 (SEQ ID NO:392),
HSCOC4_PEA.sub.--1_T8 (SEQ ID NO:393),
HSCOC4_PEA.sub.--1_T11 (SEQ ID NO:394),
HSCOC4_PEA.sub.--1_T12 (SEQ ID NO:395),
HSCOC4_PEA.sub.--1_T14 (SEQ ID NO:396),
HSCOC4_PEA.sub.--1_T20 (SEQ ID NO:398),
HSCOC4_PEA.sub.--1_T21 (SEQ ID NO:399),
HSCOC4_PEA.sub.--1_T25 (SEQ ID NO:400),
HSCOC4_PEA.sub.--1_T28 (SEQ ID NO:401),
HSCOC4_PEA.sub.--1_T30 (SEQ ID NO:402),
HSCOC4_PEA.sub.--1_T31 (SEQ ID NO:403) and
HSCOC4_PEA.sub.--1_T32 (SEQ ID NO:404). Table 131 below describes the starting and ending position of this segment on each transcript. TABLE-US-00824 TABLE 131 Segment location on transcripts Segment Segment Transcript name starting position ending position HSCOC4_PEA__1_T1 (SEQ ID 4985 5031 NO: 387) HSCOC4_PEA__1_T2 (SEQ ID 5130 5176 NO: 388) HSCOC4_PEA__1_T3 (SEQ ID 5243 5289 NO: 389) HSCOC4_PEA__1_T4 (SEQ ID 5051 5097 NO: 390) HSCOC4_PEA__1_T5 (SEQ ID 4971 5017 NO: 391) HSCOC4_PEA__1_T7 (SEQ ID 4669 4715 NO: 392) HSCOC4_PEA__1_T8 (SEQ ID 4872 4918 NO: 393) HSCOC4_PEA__1_T11 (SEQ ID 5921 5967 NO: 394) HSCOC4_PEA__1_T12 (SEQ ID 4872 4918 NO: 395) HSCOC4_PEA__1_T14 (SEQ ID 5265 5311 NO: 396) HSCOC4_PEA__1_T20 (SEQ ID 5347 5393 NO: 398) HSCOC4_PEA__1_T21 (SEQ ID 4872 4918 NO: 399) HSCOC4_PEA__1_T25 (SEQ ID 4872 4918 NO: 400) HSCOC4_PEA__1_T28 (SEQ ID 4872 4918 NO: 401) HSCOC4_PEA__1_T30 (SEQ ID 4872 4918 NO: 402) HSCOC4_PEA__1_T31 (SEQ ID 4872 4918 NO: 403) HSCOC4_PEA__1_T32 (SEQ ID 4872 4918 NO: 404)

Segment cluster HSCOC4_PEA.sub.--1_node.sub.--86 (SEQ ID NO:467) according to the present invention is supported by 7 libraries. The number of libraries was determined as previously described. This segment can be found in the following transcript(s): HSCOC4_PEA.sub.--1_T12 (SEQ ID NO:395). Table 132 below describes the starting and ending position of this segment on each transcript. TABLE-US-00825 TABLE 132 Segment location on transcripts Segment Segment Transcript name starting position ending position HSCOC4_PEA__1_T12 (SEQ ID 4919 5032 NO: 395)

Segment cluster HSCOC4_PEA.sub.--1_node.sub.--87 (SEQ ID NO:468) according to the present invention is supported by 74 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388),
HSCOC4_PEA.sub.--1_T3 (SEQ ID NO:389),
HSCOC4_PEA.sub.--1_T4 (SEQ ID NO:390),
HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 133 below describes the starting and ending position of this segment on each transcript. TABLE-US-00826 TABLE 133 Segment location on transcripts Segment Segment Transcript name starting position ending position HSCOC4_PEA_1_T1 (SEQ ID 5032 5122 NO: 387) HSCOC4_PEA_1_T2 (SEQ ID 5177 5267 NO: 388) HSCOC4_PEA_1_T3 (SEQ ID 5290 5380 NO: 389) HSCOC4_PEA_1_T4 (SEQ ID 5098 5188 NO: 390) HSCOC4_PEA_1_T5 (SEQ ID 5018 5108 NO: 391) HSCOC4_PEA_1_T7 (SEQ ID 4716 4806 NO: 392) HSCOC4_PEA_1_T8 (SEQ ID 4919 5009 NO: 393) HSCOC4_PEA_1_T11 (SEQ ID 5968 6058 NO: 394) HSCOC4_PEA_1_T12 (SEQ ID 5033 5123 NO: 395) HSCOC4_PEA_1_T14 (SEQ ID 5312 5402 NO: 396) HSCOC4_PEA_1_T15 (SEQ ID 4872 4962 NO: 397) HSCOC4_PEA_1_T20 (SEQ ID 5394 5484 NO: 398) HSCOC4_PEA_1_T21 (SEQ ID 4919 5009 NO: 399) HSCOC4_PEA_1_T25 (SEQ ID 4919 5009 NO: 400) HSCOC4_PEA_1_T28 (SEQ ID 4919 5009 NO: 401) HSCOC4_PEA_1_T30 (SEQ ID 4919 5009 NO: 402) HSCOC4_PEA_1_T31 (SEQ ID 4919 5009 NO: 403) HSCOC4_PEA_1_T32 (SEQ ID 4919 5009 NO: 404)

Segment cluster HSCOC4_PEA.sub.--1_node.sub.--88 (SEQ ID NO:469) according to the present invention is supported by 2 libraries. The number of libraries was determined as previously described. This segment can be found in the following transcript(s): HSCOC4_PEA.sub.--1_T12 (SEQ ID NO:395). Table 134 below describes the starting and ending position of this segment on each transcript. TABLE-US-00827 TABLE 134 Segment location on transcripts Segment Segment Transcript name starting position ending position HSCOC4_PEA_1_T12 (SEQ ID 5124 5213 NO: 395)

Segment cluster HSCOC4_PEA.sub.--1_node.sub.--89 (SEQ ID NO:470) according to the present invention can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 135 below describes the starting and ending position of this segment on each transcript. TABLE-US-00828 TABLE 135 Segment location on transcripts Segment Segment Transcript name starting position ending position HSCOC4_PEA_1_T1 (SEQ ID 5123 5131 NO: 387) HSCOC4_PEA_1_T2 (SEQ ID 5268 5276 NO: 388) HSCOC4_PEA_1_T3 (SEQ ID 5381 5389 NO: 389) HSCOC4_PEA_1_T4 (SEQ ID 5189 5197 NO: 390) HSCOC4_PEA_1_T5 (SEQ ID 5109 5117 NO: 391) HSCOC4_PEA_1_T7 (SEQ ID 4807 4815 NO: 392) HSCOC4_PEA_1_T8 (SEQ ID 5010 5018 NO: 393) HSCOC4_PEA_1_T11 (SEQ ID 6059 6067 NO: 394) HSCOC4_PEA_1_T12 (SEQ ID 5214 5222 NO: 395) HSCOC4_PEA_1_T14 (SEQ ID 5403 5411 NO: 396) HSCOC4_PEA_1_T15 (SEQ ID 4963 4971 NO: 397) HSCOC4_PEA_1_T20 (SEQ ID 5485 5493 NO: 398) HSCOC4_PEA_1_T21 (SEQ ID 5010 5018 NO: 399) HSCOC4_PEA_1_T25 (SEQ ID 5010 5018 NO: 400) HSCOC4_PEA_1_T28 (SEQ ID 5010 5018 NO: 401) HSCOC4_PEA_1_T30 (SEQ ID 5010 5018 NO: 402) HSCOC4_PEA_1_T31 (SEQ ID 5010 5018 NO: 403) HSCOC4_PEA_1_T32 (SEQ ID 5010 5018 NO: 404)

Segment cluster HSCOC4_PEA.sub.--1_node.sub.--90 (SEQ ID NO:471) according to the present invention can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 136 below describes the starting and ending position of this segment on each transcript. TABLE-US-00829 TABLE 136 Segment location on transcripts Segment Segment Transcript name starting position ending position HSCOC4_PEA_1_T1 (SEQ ID 5132 5142 NO: 387) HSCOC4_PEA_1_T2 (SEQ ID 5277 5287 NO: 388) HSCOC4_PEA_1_T3 (SEQ ID 5390 5400 NO: 389) HSCOC4_PEA_1_T4 (SEQ ID 5198 5208 NO: 390) HSCOC4_PEA_1_T5 (SEQ ID 5118 5128 NO: 391) HSCOC4_PEA_1_T7 (SEQ ID 4816 4826 NO: 392) HSCOC4_1_PEA_1_T8 (SEQ ID 5019 5029 NO: 393) HSCOC4_PEA_1_T11 (SEQ ID 6068 6078 NO: 394) HSCOC4_PEA_1_T12 (SEQ ID 5223 5233 NO: 395) HSCOC4_PEA_1_T14 (SEQ ID 5412 5422 NO: 396) HSCOC4_PEA_1_15 (SEQ ID 4972 4982 NO: 397) HSCOC4_PEA_1_T20 (SEQ ID 5494 5504 NO: 398) HSCOC4_PEA_1_T21 (SEQ ID 5019 5029 NO: 399) HSCOC4_PEA_1_T25 (SEQ ID 5019 5029 NO: 400) HSCOC4_PEA_1_T28 (SEQ ID 5019 5029 NO: 401) HSCOC4_PEA_1_T30 (SEQ ID 5019 5029 NO: 402) HSCOC4_PEA_1_T31 (SEQ ID 5019 5029 NO: 403) HSCOC4_PEA_1_T32 (SEQ ID 5019 5029 NO: 404)

Segment cluster HSCOC4_PEA.sub.--1_node.sub.--91 (SEQ ID NO:472) according to the present invention is supported by 78 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 137 below describes the starting and ending position of this segment on each transcript. TABLE-US-00830 TABLE 137 Segment location on transcripts Segment Segment Transcript name starting position ending position HSCOC4_PEA_1_T1 (SEQ ID 5143 5179 NO: 387) HSCOC4_PEA_1_T2 (SEQ ID 5288 5324 NO: 388) HSCOC4_PEA_1_T3 (SEQ ID 5401 5437 NO: 389) HSCOC4_PEA_1_T4 (SEQ ID 5209 5245 NO: 390) HSCOC4_PEA_1_T5 (SEQ ID 5129 5165 NO: 391) HSCOC4_PEA_1_T7 (SEQ ID 4827 4863 NO: 392) HSCOC4_PEA_1_T8 (SEQ ID 5030 5066 NO: 393) HSCOC4_PEA_1_T11 (SEQ ID 6079 6115 NO: 394) HSCOC4_PEA_1_T12 (SEQ ID 5234 5270 NO: 395) HSCOC4_PEA_1_T14 (SEQ ID 5423 5459 NO: 396) HSCOC4_PEA_1_T15 (SEQ ID 4983 5019 NO: 397) HSCOC4_PEA_1_T20 (SEQ ID 5505 5541 NO: 398) HSCOC4_PEA_1_T21 (SEQ ID 5030 5066 NO: 399) HSCOC4_PEA_1_T25 (SEQ ID 5030 5066 NO: 400) HSCOC4_PEA_1_T28 (SEQ ID 5030 5066 NO: 401) HSCOC4_PEA_1_T30 (SEQ ID 5030 5066 NO: 402) HSCOC4_PEA_1_T31 (SEQ ID 5030 5066 NO: 403) HSCOC4_PEA_1_T32 (SEQ ID 5030 5066 NO: 404)

Segment cluster HSCOC4_PEA.sub.--1_node.sub.--92 (SEQ ID NO:473) according to the present invention can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403) and HSCOC4_PEA.sub.--1_T32 (SEQ ID NO:404). Table 138 below describes the starting and ending position of this segment on each transcript. TABLE-US-00831 TABLE 138 Segment location on transcripts Segment Segment Transcript name starting position ending position HSCOC4_PEA_1_T1 (SEQ ID 5180 5197 NO: 387) HSCOC4_PEA_1_T2 (SEQ ID 5325 5342 NO: 388) HSCOC4_PEA_1_T3 (SEQ ID 5438 5455 NO: 389) HSCOC4_PEA_1_T4 (SEQ ID 5246 5263 NO: 390) HSCOC4_PEA_1_T5 (SEQ ID 5166 5183 NO: 391) HSCOC4_PEA_1_T7 (SEQ ID 4864 4881 NO: 392) HSCOC4_PEA_1_T8 (SEQ ID 5067 5084 NO: 393) HSCOC4_PEA_1_T11 (SEQ ID 6116 6133 NO: 394) HSCOC4_PEA_1_T12 (SEQ ID 5271 5288 NO: 395) HSCOC4_PEA_1_T14 (SEQ ID 5460 5477 NO: 396) HSCOC4_PEA_1_T15 (SEQ ID 5020 5037 NO: 397) HSCOC4_PEA_1_T20 (SEQ ID 5542 5559 NO: 398) HSCOC4_PEA_1_T21 (SEQ ID 5067 5084 NO: 399) HSCOC4_PEA_1_T25 (SEQ ID 5067 5084 NO: 400) HSCOC4_PEA_1_T28 (SEQ ID 5067 5084 NO: 401) HSCOC4_PEA_1_T30 (SEQ ID 5067 5084 NO: 402) HSCOC4_PEA_1_T31 (SEQ ID 5067 5084 NO: 403) HSCOC4_PEA_1_T32 (SEQ ID 5067 5084 NO: 404)

Segment cluster HSCOC4_PEA.sub.--1_node.sub.--94 (SEQ ID NO:474) according to the present invention can be found in the following transcript(s): HSCOC4_PEA.sub.--1_T8 (SEQ ID NO:393), HSCOC4_PEA.sub.--1_T12 (SEQ ID NO:395) and HSCOC4_PEA.sub.--1_T21 (SEQ ID NO:399). Table 139 below describes the starting and ending position of this segment on each transcript. TABLE-US-00832 TABLE 139 Segment location on transcripts Segment Segment Transcript name starting position ending position HSCOC4_PEA_1_T8 (SEQ ID 6567 6575 NO: 393) HSCOC4_PEA_1_T12 (SEQ ID 6771 6779 NO: 395) HSCOC4_PEA_1_T21 (SEQ ID 6567 6575 NO: 399)

Segment cluster HSCOC4_PEA.sub.--1_node.sub.--96 (SEQ ID NO:475) according to the present invention can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T31 (SEQ ID NO:403) and HSCOC4_PEA.sub.--1_T32 (SEQ ID NO:404). Table 140 below describes the starting and ending position of this segment on each transcript. TABLE-US-00833 TABLE 140 Segment location on transcripts Segment Segment Transcript name starting position ending position HSCOC4_PEA_1_T1 (SEQ ID 5198 5205 NO: 387) HSCOC4_PEA_1_T2 (SEQ ID 5343 5350 NO: 388) HSCOC4_PEA_1_T3 (SEQ ID 5456 5463 NO: 389) HSCOC4_PEA_1_T4 (SEQ ID 5264 5271 NO: 390) HSCOC4_PEA_1_T5 (SEQ ID 5184 5191 NO: 391) HSCOC4_PEA_1_T7 (SEQ ID 4882 4889 NO: 392) HSCOC4_PEA_1_T8 (SEQ ID 6576 6583 NO: 393) HSCOC4_PEA_1_T11 (SEQ ID 6134 6141 NO: 394) HSCOC4_PEA_1_T12 (SEQ ID 6780 6787 NO: 395) HSCOC4_PEA_1_T14 (SEQ ID 5478 5485 NO: 396) HSCOC4_PEA_1_T15 (SEQ ID 5038 5045 NO: 397) HSCOC4_PEA_1_T20 (SEQ ID 5560 5567 NO: 398) HSCOC4_PEA_1_T21 (SEQ ID 6576 6583 NO: 399) HSCOC4_PEA_1_T25 (SEQ ID 5085 5092 NO: 400) HSCOC4_PEA_1_T28 (SEQ ID 5085 5092 NO: 401) HSCOC4_PEA_1_T31 (SEQ ID 5085 5092 NO: 403) HSCOC4_PEA_1_T32 (SEQ ID 5085 5092 NO: 404)

Segment cluster HSCOC4_PEA.sub.--1_node.sub.--97 (SEQ ID NO:476) according to the present invention can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T31 (SEQ ID NO:403) and HSCOC4_PEA.sub.--1_T32 (SEQ ID NO:404). Table 141 below describes the starting and ending position of this segment on each transcript. TABLE-US-00834 TABLE 141 Segment location on transcripts Segment Segment Transcript name starting position ending position HSCOC4_PEA_1_T1 (SEQ ID 5206 5222 NO: 387) HSCOC4_PEA_1_T2 (SEQ ID 5351 5367 NO: 388) HSCOC4_PEA_1_T3 (SEQ ID 5464 5480 NO: 389) HSCOC4_PEA_1_T4 (SEQ ID 5272 5288 NO: 390) HSCOC4_PEA_1_T5 (SEQ ID 5192 5208 NO: 391) HSCOC4_PEA_1_T7 (SEQ ID 4890 4906 NO: 392) HSCOC4_PEA_1_T8 (SEQ ID 6584 6600 NO: 393) HSCOC4_PEA_1_T11 (SEQ ID 6142 6158 NO: 394) HSCOC4_PEA_1_T12 (SEQ ID 6788 6804 NO: 395) HSCOC4_PEA_1_T14 (SEQ ID 5486 5502 NO: 396) HSCOC4_PEA_1_T15 (SEQ ID 5046 5062 NO: 397) HSCOC4_PEA_1_T20 (SEQ ID 5568 5584 NO: 398) HSCOC4_PEA_1_T21 (SEQ ID 6584 6600 NO: 399) HSCOC4_PEA_1_T25 (SEQ ID 5093 5109 NO: 400) HSCOC4_PEA_1_T28 (SEQ ID 5093 5109 NO: 401) HSCOC4_PEA_1_T31 (SEQ ID 5093 5109 NO: 403) HSCOC4_PEA_1_T32 (SEQ ID 5093 5109 NO: 404)

Segment cluster HSCOC4_PEA.sub.--1_node.sub.--98 (SEQ ID NO:477) according to the present invention is supported by 93 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T31 (SEQ ID NO:403) and HSCOC4_PEA.sub.--1_T32 (SEQ ID NO:404). Table 142 below describes the starting and ending position of this segment on each transcript. TABLE-US-00835 TABLE 142 Segment location on transcripts Segment Segment Transcript name starting position ending position HSCOC4_PEA_1_T1 (SEQ ID 5223 5271 NO: 387) HSCOC4_PEA_1_T2 (SEQ ID 5368 5416 NO: 388) HSCOC4_PEA_1_T3 (SEQ ID 5481 5529 NO: 389) HSCOC4_PEA_1_T4 (SEQ ID 5289 5337 NO: 390) HSCOC4_PEA_1_T5 (SEQ ID 5209 5257 NO: 391) HSCOC4_PEA_1_T7 (SEQ ID 4907 4955 NO: 392) HSCOC4_PEA_1_T8 (SEQ ID 6601 6649 NO: 393) HSCOC4_PEA_1_T11 (SEQ ID 6159 6207 NO: 394) HSCOC4_PEA_1_T12 (SEQ ID 6805 6853 NO: 395) HSCOC4_PEA_1_T14 (SEQ ID 5503 5551 NO: 396) HSCOC4_PEA_1_T15 (SEQ ID 5063 5111 NO: 397) HSCOC4_PEA_1_T20 (SEQ ID 5585 5633 NO: 398) HSCOC4_PEA_1_T21 (SEQ ID 6601 6649 NO: 399) HSCOC4_PEA_1_T25 (SEQ ID 5110 5158 NO: 400) HSCOC4_PEA_1_T28 (SEQ ID 5110 5158 NO: 401) HSCOC4_PEA_T31 (SEQ ID 5110 5158 NO: 403) HSCOC4_PEA_1_T32 (SEQ ID 5110 5158 NO: 404)

Segment cluster HSCOC4_PEA.sub.--1_node.sub.--99 (SEQ ID NO:478) according to the present invention is supported by 93 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 143 below describes the starting and ending position of this segment on each transcript. TABLE-US-00836 TABLE 143 Segment location on transcripts Segment Segment Transcript name starting position ending position HSCOC4_PEA_1_T1 (SEQ ID 5272 5300 NO: 387) HSCOC4_PEA_1_T2 (SEQ ID 5417 5445 NO: 388) HSCOC4_PEA_1_T3 (SEQ ID 5530 5558 NO: 389) HSCOC4_PEA_1_T4 (SEQ ID 5338 5366 NO: 390) HSCOC4_PEA_1_T5 (SEQ ID 5258 5286 NO: 391) HSCOC4_PEA_1_T7 (SEQ ID 4956 4984 NO: 392) HSCOC4_PEA_1_T8 (SEQ ID 6650 6678 NO: 393) HSCOC4_PEA_1_T11 (SEQ ID 6208 6236 NO: 394) HSCOC4_PEA_1_T12 (SEQ ID 6854 6882 NO: 395) HSCOC4_PEA_1_T14 (SEQ ID 5552 5580 NO: 396) HSCOC4_PEA_1_T15 (SEQ ID 5112 5140 NO: 397) HSCOC4_PEA_1_T20 (SEQ ID 5634 5662 NO: 398) HSCOC4_PEA_1_T21 (SEQ ID 6650 6678 NO: 399) HSCOC4_PEA_1_T25 (SEQ ID 5159 5187 NO: 400) HSCOC4_PEA_1_T28 (SEQ ID 5159 5187 NO: 401) HSCOC4_PEA_1_T31 (SEQ ID 5159 5187 NO: 403) HSCOC4_PEA_1_T32 (SEQ ID 5159 5187 NO: 404) HSCOC4_PEA_1_T40 (SEQ ID 4197 4225 NO: 405)

Segment cluster HSCOC4_PEA.sub.--1_node.sub.--101 (SEQ ID NO:479) according to the present invention is supported by 116 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 144 below describes the starting and ending position of this segment on each transcript. TABLE-US-00837 TABLE 144 Segment location on transcripts Segment Segment Transcript name starting position ending position HSCOC4_PEA__1_T1 (SEQ ID 5301 5390 NO: 387) HSCOC4_PEA__1_T2 (SEQ ID 5446 5535 NO: 388) HSCOC4_PEA__1_T3 (SEQ ID 5559 5648 NO: 389) HSCOC4_PEA__1_T4 (SEQ ID 5367 5456 NO: 390) HSCOC4_PEA__1_T5 (SEQ ID 5287 5376 NO: 391) HSCOC4_PEA__1_T7 (SEQ ID 4985 5074 NO: 392) HSCOC4_PEA__1_T8 (SEQ ID 6679 6768 NO: 393) HSCOC4_PEA__1_T11 (SEQ ID 6237 6326 NO: 394) HSCOC4_PEA__1_T12 (SEQ ID 6883 6972 NO: 395) HSCOC4_PEA__1_T14 (SEQ ID 5581 5670 NO: 396) HSCOC4_PEA__1_T15 (SEQ ID 5141 5230 NO: 397) HSCOC4_PEA__1_T20 (SEQ ID 5663 5752 NO: 398) HSCOC4_PEA__1_T21 (SEQ ID 6844 6933 NO: 399) HSCOC4_PEA__1_T25 (SEQ ID 5188 5277 NO: 400) HSCOC4_PEA__1_T28 (SEQ ID 5188 5277 NO: 401) HSCOC4_PEA__1_T30 (SEQ ID 5085 5174 NO: 402) HSCOC4_PEA__1_T31 (SEQ ID 5188 5277 NO: 403) HSCOC4_PEA__1_T32 (SEQ ID 5188 5277 NO: 404) HSCOC4_PEA__1_T40 (SEQ ID 4226 4315 NO: 405)

Segment cluster HSCOC4_PEA.sub.--1_node.sub.--102 (SEQ ID NO:480) according to the present invention is supported by 3 libraries. The number of libraries was determined as previously described. This segment can be found in the following transcript(s): HSCOC4_PEA.sub.--1_T31 (SEQ ID NO:403) and HSCOC4_PEA.sub.--1_T32 (SEQ ID NO:404). Table 145 below describes the starting and ending position of this segment on each transcript. TABLE-US-00838 TABLE 145 Segment location on transcripts Segment Segment Transcript name starting position ending position HSCOC4_PEA__1_T31 (SEQ ID 5278 5362 NO: 403) HSCOC4_PEA__1_T32 (SEQ ID 5278 5362 NO: 404)

Segment cluster HSCOC4_PEA.sub.--1_node.sub.--103 (SEQ ID NO:481) according to the present invention is supported by 106 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 146 below describes the starting and ending position of this segment on each transcript. TABLE-US-00839 TABLE 146 Segment location on transcripts Segment Segment Transcript name starting position ending position HSCOC4_PEA__1_T1 (SEQ ID 5391 5463 NO: 387) HSCOC4_PEA__1_T2 (SEQ ID 5536 5608 NO: 388) HSCOC4_PEA__1_T3 (SEQ ID 5649 5721 NO: 389) HSCOC4_PEA__1_T4 (SEQ ID 5457 5529 NO: 390) HSCOC4_PEA__1_T5 (SEQ ID 5377 5449 NO: 391) HSCOC4_PEA__1_T7 (SEQ ID 5075 5147 NO: 392) HSCOC4_PEA__1_T8 (SEQ ID 6769 6841 NO: 393) HSCOC4_PEA__1_T11 (SEQ ID 6327 6399 NO: 394) HSCOC4_PEA__1_T12 (SEQ ID 6973 7045 NO: 395) HSCOC4_PEA__1_T14 (SEQ ID 5671 5743 NO: 396) HSCOC4_PEA__1_T15 (SEQ ID 5231 5303 NO: 397) HSCOC4_PEA__1_T20 (SEQ ID 5753 5825 NO: 398) HSCOC4_PEA__1_T21 (SEQ ID 6934 7006 NO: 399) HSCOC4_PEA__1_T25 (SEQ ID 5278 5350 NO: 400) HSCOC4_PEA__1_T28 (SEQ ID 5278 5350 NO: 401) HSCOC4_PEA__1_T30 (SEQ ID 5175 5247 NO: 402) HSCOC4_PEA__1_T31 (SEQ ID 5363 5435 NO: 403) HSCOC4_PEA__1_T32 (SEQ ID 5363 5435 NO: 404) HSCOC4_PEA__1_T40 (SEQ ID 4316 4388 NO: 405)

Segment cluster HSCOC4_PEA.sub.--1_node.sub.--104 (SEQ ID NO:482) according to the present invention is supported by 101 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1.sub.T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 147 below describes the starting and ending position of this segment on each transcript. TABLE-US-00840 TABLE 147 Segment location on transcripts Segment Segment Transcript name starting position ending position HSCOC4_PEA__1_T1 (SEQ ID 5464 5489 NO: 387) HSCOC4_PEA__1_T2 (SEQ ID 5609 5634 NO: 388) HSCOC4_PEA__1_T3 (SEQ ID 5722 5747 NO: 389) HSCOC4_PEA__1_T4 (SEQ ID 5530 5555 NO: 390) HSCOC4_PEA__1_T5 (SEQ ID 5450 5475 NO: 391) HSCOC4_PEA__1_T7 (SEQ ID 5148 5173 NO: 392) HSCOC4_PEA__1_T8 (SEQ ID 6842 6867 NO: 393) HSCOC4_PEA__1_T11 (SEQ ID 6400 6425 NO: 394) HSCOC4_PEA__1_T12 (SEQ ID 7046 7071 NO: 395) HSCOC4_PEA__1_T14 (SEQ ID 5744 5769 NO: 396) HSCOC4_PEA__1_T15 (SEQ ID 5304 5329 NO: 397) HSCOC4_PEA__1_T20 (SEQ ID 5826 5851 NO: 398) HSCOC4_PEA__1_T21 (SEQ ID 7007 7032 NO: 399) HSCOC4_PEA__1_T25 (SEQ ID 5351 5376 NO: 400) HSCOC4_PEA__1_T28 (SEQ ID 5351 5376 NO: 401) HSCOC4_PEA__1_T30 (SEQ ID 5248 5273 NO: 402) HSCOC4_PEA__1_T31 (SEQ ID 5436 5461 NO: 403) HSCOC4_PEA__1_T32 (SEQ ID 5436 5461 NO: 404) HSCOC4_PEA__1_T40 (SEQ ID 4389 4414 NO: 405)

Segment cluster HSCOC4_PEA.sub.--1_node.sub.--106 (SEQ ID NO:483) according to the present invention is supported by 110 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 148 below describes the starting and ending position of this segment on each transcript.

TABLE-US-00841 TABLE 148 Segment location on transcripts

| Segment name | Segment starting position | Transcript ending position |
|---|---|---|
| HSCOC4_PEA_1_T1 (SEQ ID NO: 387) | 5490 | 5573 |
| HSCOC4_PEA_1_T2 (SEQ ID NO: 388) | 5635 | 5718 |
| HSCOC4_PEA_1_T3 (SEQ ID NO: 389) | 5748 | 5831 |
| HSCOC4_PEA_1_T4 (SEQ ID NO: 390) | 5556 | 5639 |
| HSCOC4_PEA_1_T5 (SEQ ID NO: 391) | 5476 | 5559 |
| HSCOC4_PEA_1_T7 (SEQ ID NO: 392) | 5174 | 5257 |
| HSCOC4_PEA_1_T8 (SEQ ID NO: 393) | 6868 | 6951 |
| HSCOC4_PEA_1_T11 (SEQ ID NO: 394) | 6426 | 6509 |
| HSCOC4_PEA_1_T12 (SEQ ID NO: 395) | 7072 | 7155 |
| HSCOC4_PEA_1_T14 (SEQ ID NO: 396) | 5770 | 5853 |
| HSCOC4_PEA_1_T15 (SEQ ID NO: 397) | 5330 | 5413 |
| HSCOC4_PEA_1_T20 (SEQ ID NO: 398) | 5852 | 5935 |
| HSCOC4_PEA_1_T21 (SEQ ID NO: 399) | 7033 | 7116 |
| HSCOC4_PEA_1_T25 (SEQ ID NO: 400) | 5377 | 5460 |
| HSCOC4_PEA_1_T28 (SEQ ID NO: 401) | 5559 | 5642 |
| HSCOC4_PEA_1_T30 (SEQ ID NO: 402) | 5274 | 5357 |
| HSCOC4_PEA_1_T31 (SEQ ID NO: 403) | 5462 | 5545 |
| HSCOC4_PEA_1_T32 (SEQ ID NO: 404) | 5644 | 5727 |
| HSCOC4_PEA_1_T40 (SEQ ID NO: 405) | 4415 | 4498 |

Segment cluster HSCOC4_PEA.sub.--1_node.sub.--111 (SEQ ID NO:484) according to the present invention is supported by 77 libraries. The number of libraries was determined as previously described. This segment can be found in the following transcript(s): HSCOC4_PEA.sub.--1_T1 (SEQ ID NO:387), HSCOC4_PEA.sub.--1_T2 (SEQ ID NO:388), HSCOC4_PEA.sub.--1_T3 (SEQ ID NO:389), HSCOC4_PEA.sub.--1_T4 (SEQ ID NO:390), HSCOC4_PEA.sub.--1_T5 (SEQ ID NO:391), HSCOC4_PEA.sub.--1_T7 (SEQ ID NO:392), HSCOC4_PEA.sub.--1_T8 (SEQ ID NO:393), HSCOC4_PEA.sub.--1_T11 (SEQ ID NO:394), HSCOC4_PEA.sub.--1_T12 (SEQ ID NO:395), HSCOC4_PEA.sub.--1_T14 (SEQ ID NO:396), HSCOC4_PEA.sub.--1_T15 (SEQ ID NO:397), HSCOC4_PEA.sub.--1_T20 (SEQ ID NO:398), HSCOC4_PEA.sub.--1_T21 (SEQ ID NO:399), HSCOC4_PEA.sub.--1_T25 (SEQ ID NO:400), HSCOC4_PEA.sub.--1_T28 (SEQ ID NO:401), HSCOC4_PEA.sub.--1_T30 (SEQ ID NO:402), HSCOC4_PEA.sub.--1_T31 (SEQ ID NO:403), HSCOC4_PEA.sub.--1_T32 (SEQ ID NO:404) and HSCOC4_PEA.sub.--1_T40 (SEQ ID NO:405). Table 149 below describes the starting and ending position of this segment on each transcript.

TABLE-US-00842 TABLE 149 Segment location on transcripts

| Segment name | Segment starting position | Transcript ending position |
|---|---|---|
| HSCOC4_PEA_1_T1 (SEQ ID NO: 387) | 5857 | 5947 |
| HSCOC4_PEA_1_T2 (SEQ ID NO: 388) | 6002 | 6092 |
| HSCOC4_PEA_1_T3 (SEQ ID NO: 389) | 6115 | 6205 |
| HSCOC4_PEA_1_T4 (SEQ ID NO: 390) | 5923 | 6013 |
| HSCOC4_PEA_1_T5 (SEQ ID NO: 391) | 5843 | 5933 |
| HSCOC4_PEA_1_T7 (SEQ ID NO: 392) | 5541 | 5631 |
| HSCOC4_PEA_1_T8 (SEQ ID NO: 393) | 7235 | 7325 |
| HSCOC4_PEA_1_T11 (SEQ ID NO: 394) | 6793 | 6883 |
| HSCOC4_PEA_1_T12 (SEQ ID NO: 395) | 7439 | 7529 |
| HSCOC4_PEA_1_T14 (SEQ ID NO: 396) | 6137 | 6227 |
| HSCOC4_PEA_1_T15 (SEQ ID NO: 397) | 5697 | 5787 |
| HSCOC4_PEA_1_T20 (SEQ ID NO: 398) | 6219 | 6309 |
| HSCOC4_PEA_1_T21 (SEQ ID NO: 399) | 7400 | 7490 |
| HSCOC4_PEA_1_T25 (SEQ ID NO: 400) | 6149 | 6239 |
| HSCOC4_PEA_1_T28 (SEQ ID NO: 401) | 6331 | 6421 |
| HSCOC4_PEA_1_T30 (SEQ ID NO: 402) | 5641 | 5731 |
| HSCOC4_PEA_1_T31 (SEQ ID NO: 403) | 5829 | 5919 |
| HSCOC4_PEA_1_T32 (SEQ ID NO: 404) | 6273 | 6363 |
| HSCOC4_PEA_1_T40 (SEQ ID NO: 405) | 4782 | 4872 |

Variant protein alignment to the previously known protein:

Sequence name: CO4_HUMAN (SEQ ID NO:485)

Sequence documentation:

Alignment of: HSCOC4_PEA.sub.--1_P3 (SEQ ID NO:488).times.CO4_HUMAN (SEQ ID NO:485).

Alignment segment 1/1: TABLE-US-00843 Quality: 8438.00 Escore: 0 Matching length: 870 Total length: 870 Matching Percent Similarity: 99.66 Matching Percent Identity: 99.66 Total Percent Similarity: 99.66 Total Percent Identity: 99.66 Gaps: 0

```
Alignment: TABLE-US-00844 . . . 1
MRLLWGLIWASSFFTLSLQKPRLLLFSPSVVHLGVPLSVGVQLQDVPRGQ   50
||||||||||||||||||||||||||||||||||||||||||||||||||    1
MRLLWGLIWASSFFTLSLQKPRLLLFSPSVVHLGVPLSVGVQLQDVPRGQ   50 . . . 51

VVKGSVFLRNPSRNNVPCSPKVDFTLSSERDFALLSLQVPLKDAKSCGLH  100
||||||||||||||||||||||||||||||||||||||||||||||||||   51
VVKGSVFLRNPSRNNVPCSPKVDFTLSSERDFALLSLQVPLKDAKSCGLH  100 . . . 101

QLLRGPEVQLVAHSPWLKDSLSRTTNIQGINLLFSSRRGHLFLQTDQPIY  150
||||||||||||||||||||||||||||||||||||||||||||||||||  101
QLLRGPEVQLVAHSPWLKDSLSRTTNIQGINLLFSSRRGHLFLQTDQPIY  150 . . . 151

NPGQRVRYRVFALDQKMRPSTDTITVMVENSHGLRVRKKEVYMPSSIFQD  200
||||||||||||||||||||||||||||||||||||||||||||||||||  151
NPGQRVRYRVFALDQKMRPSTDTITVMVENSHGLRVRKKEVYMPSSIFQD  200 . . . 201

DFVIPDISEPGTWKISARFSDGLESNSSTQFEVKKYVLPNFEVKITPGKP  250
||||||||||||||||||||||||||||||||||||||||||||||||||  201
```

-continued

```
DFVIPDISEPGTWKISARFSDGLESNSSTQFEVKKYVLPNFEVKITPGKP   250  ...  251

YILTVPGHLDEMQLDIQARYIYGKPVQGVAYVRFGLLDEDGKKTFFRGLE   300
|||||||||||||||||||||||||||||||||||||||||||||||||   251
YILTVPGHLDEMQLDIQARYIYGKPVQGVAYVRFGLLDEDGKKTFFRGLE   300  ...  301

SQTKLVNGQSHISLSKAEFQDALEKLNMGITDLQGLRLYVAAAIIESPGG   350
|||||||||||||||||||||||||||||||||||||||||||||||||   301
SQTKLVNGQSHISLSKAEFQDALEKLNMGITDLQGLRLYVAAAIIESPGG   350  ...  351

EMEEAELTSWYFVSSPFSLDLSKTKRHLVPGAPFLLQALVREMSGSPASG   400
|||||||||||||||||||||||||||||||||||||||||||||||||   351
EMEEAELTSWYFVSSPFSLDLSKTKRHLVPGAPFLLQALVREMSGSPASG   400  ...  401

IPVKVSATVSSPGSVPEVQDIQQNTDGSGQVSIPIIIPQTISELQLSVSA   450
|||||||||||||||||||||||||||||||||||||||||||||||||   401
IPVKVSATVSSPGSVPEVQDIQQNTDGSGQVSIPIIIPQTISELQLSVSA   450  ...  451

GSPHPAIARLTVAAPPSGGPGFLSIERPDSRPPRVGDTLNLNLRAVGSGA   500
|||||||||||||||||||||||||||||||||||||||||||||||||   451
GSPHPAIARLTVAAPPSGGPGFLSIERPDSRPPRVGDTLNLNLRAVGSGA   500  ...  501

TFSHYYYMILSRGQIVFMNREPKRTLTSVSVFVDHHLAPSFYFVAFYYHG   550
|||||||||||||||||||||||||||||||||||||||||||||||||   501
TFSHYYYMILSRGQIVFMNREPKRTLTSVSVFVDHHLAPSFYFVAFYYHG   550  ...  551

DHPVANSLRVDVQAGACEGKLELSVDGAKQYRNGESVKLHLETDSLALVA   600
|||||||||||||||||||||||||||||||||||||||||||||||||   551
DHPVANSLRVDVQAGACEGKLELSVDGAKQYRNGESVKLHLETDSLALVA   600  ...  601

LGALDTALYAAGSKSHKPLNMGKVFEAMNSYDLGCGPGGGDSALQVFQAA   650
|||||||||||||||||||||||||||||||||||||||||||||||||   601
LGALDTALYAAGSKSHKPLNMGKVFEAMNSYDLGCGPGGGDSALQVFQAA   650  ...  651

GLAFSDGDQWTLSRKRLSCPKEKTTRKKRNVNFQKAINEKLGQYASPTAK   700
|||||||||||||||||||||||||||||||||||||||||||||||||   651
GLAFSDGDQWTLSRKRLSCPKEKTTRKKRNVNFQKAINEKLGQYASPTAK   700  ...  701

RCCQDGVTRLPMMRSCEQRAARVQQPDCREPFLSCCQFAESLRKKSRDKG   750
|||||||||||||||||||||||||||||||||||||||||||||||||   701
RCCQDGVTRLPMMRSCEQRAARVQQPDCREPFLSCCQFAESLRKKSRDKG   750  ...  751

QAGLQRALEILQEEDLIDEDDIPVRSFFPENWLWRVETVDRFQILTLWLP   800
|||||||||||||||||||||||||||||||||||||||||||||||||   751
QAGLQRALEILQEEDLIDEDDIPVRSFFPENWLWRVETVDRFQILTLWLP   800  ...  801

DSLTWIEIHGLSLSKTKGLCVATPVQLRVFREFHLHLRLPMSVRRFEQLE   850
||| |||||||||||||||||||||||||||||||||||||||||||||   801
DSLTTWEIHGLSLSKTKGLCVATPVQLRVFREFHLHLRLPMSVRRFEQLE   850  ...  851

LRPVLYNYLDKNLTVRPHRS                                870
||||||||||||||| | |                                 851
LRPVLYNYLDKNLTVSVHVS                                870
```

Sequence name: CO4_HUMAN (SEQ ID NO:485)

Sequence documentation:

Alignment of: HSCOC4_PEA.sub.--1_P5 (SEQ ID NO:489).times.CO4_HUMAN (SEQ ID NO:485).

Alignment segment 1/1: TABLE-US-00845 Quality: 7969.00 Escore: 0 Matching length: 818 Total length: 818 Matching Percent Similarity: 100.00 Matching Percent 100.00 Identity: Total Percent Similarity: 100.00 Total Percent Identity: 100.00 Gaps: 0

```
Alignment: TABLE-US-00846  ...  1
MRLLWGLIWASSFFTLSLQKPRLLLFSPSVVHLGVPLSVGVQLQDVPRGQ   50
|||||||||||||||||||||||||||||||||||||||||||||||||   1
MRLLWGLIWASSFFTLSLQKPRLLLFSPSVVHLGVPLSVGVQLQDVPRGQ   50  ...  51

VVKGSVFLRNPSRNNVPCSPKVDFTLSSERDFALLSLQVPLKDAKSCGLH   100
|||||||||||||||||||||||||||||||||||||||||||||||||   51
VVKGSVFLRNPSRNNVPCSPKVDFTLSSERDFALLSLQVPLKDAKSCGLH   100  ...  101

QLLRGPEVQLVAHSPWLKDSLSRTTNIQGINLLFSSRRGHLFLQTDQPIY   150
|||||||||||||||||||||||||||||||||||||||||||||||||   101
QLLRGPEVQLVAHSPWLKDSLSRTTNIQGINLLFSSRRGHLFLQTDQPIY   150  ...  151

NPGQRVRYRVFALDQKMRPSTDTITVMVENSHGLRVRKKEVYMPSSIFQD   200
|||||||||||||||||||||||||||||||||||||||||||||||||   151
NPGQRVRYRVFALDQKMRPSTDTITVMVENSHGLRVRKKEVYMPSSIFQD   200  ...  201
```

-continued

```
DEVIPDISEPGTWKISARFSDGLESNSSTQFEVKKYVLPNFEVKITPGKP   250
|||||||||||||||||||||||||||||||||||||||||||||||| |   201
DFVIPDISEPGTWKISARFSDGLESNSSTQFEVKKYVLPNEEVKITPGKP   250 . . . 251

YILTVPGHLDEMQLDIQARYIYGKPVQGVAYVRFGLLDEDGKKTFFRGLE   300
|||||||||||||||||||||||||||||||||||||||||||||||||   251
YILTVPGHLDEMQLDIQARYIYGKPVQGVAYVRFGLLDEDGKKTFFRGLE   300 . . . 301

SQTKLVNGQSHISLSKAEFQDALEKLNMGITDLQGLRLYVAAAIIESPGG   350
|||||||||||||||||||||||||||||||||||||||||||||||||   301
SQTKLVNGQSHISLSKAEFQDALEKLNMGITDLQGLRLYVAAAIIESPGG   350 . . . 351

EMEEAELTSWYFVSSPFSLDLSKTKRHLVPGAPFLLQALVREMSGSPASG   400
|||||||||||||||||||||||||||||||||||||||||||||||||   351
EMEEAELTSWYFVSSPFSLDLSKTKRHLVPGAPFLLQALVREMSGSPASG   400 . . . 401

IPVKVSATVSSPGSVPEVQDIQQNTDGSGQVSIPIIIPQTISELQLSVSA   450
|||||||||||||||||||||||||||||||||||||||||||||||||   401
IPVKVSATVSSPGSVPEVQDIQQNTDGSGQVSIPIIIPQTISELQLSVSA   450 . . . 451

GSPHPAIARLTVAAPPSGGPGFLSIERPDSRPPRVGDTLNLNLRAVGSGA   500
|||||||||||||||||||||||||||||||||||||||||||||||||   451
GSPHPAIARLTVAAPPSGGPGFLSIERPDSRPPRVGDTLNLNLRAVGSGA   500 . . . 501

TFSHYYYMILSRGQIVFMNREPKRTLTSVSVFVDHHLAPSFYFVAFYYHG   550
|||||||||||||||||||||||||||||||||||||||||||||||||   501
TFSHYYYMILSRGQIVFMNREPKRTLTSVSVFVDHHLAPSFYFVAFYYHG   550 . . . 551

DHPVANSLRVDVQAGACEGKLELSVDGAKQYRNGESVKLHLETDSLALVA   600
||||||||||||||||||||||||||||||||||||||| |||||||||   551
DHPVANSLRVDVQAGACEGKLELSVDGAKQYRNGESVKLRLETDSLALVA   600 . . . 601

LGALDTALYAAGSKSHKPLNMGKVFEAMNSYDLGCGPGGGDSALQVFQAA   650
|||||||||||||||||||||||||||||||||||||||||||||||||   601
LGALDTALYAAGSKSHKPLNMGKVFEAMNSYDLGCGPGGGDSALQVFQAA   650 . . . 651

GLAFSDGDQWTLSRKRLSCPKEKTTRKKRNVNFQKAINEKLGQYASPTAK   700
|||||||||||||||||||||||||||||||||||||||||||||||||   651
GLAFSDGDQWTLSRKRLSCPKEKTTRKKRNVNFQKAINEKLGQYASPTAK   700 . . . 701

RCCQDGVTRLPMMRSCEQRAARVQQPDCREPFLSCCQFAESLRKKSRDKG   750
|||||||||||||||||||||||||||||||||||||||||||||||||   701
RCCQDGVTRLPMMRSCEQRAARVQQPDCREPFLSCCQFAESLRKKSRDKG   750 . . . 751

QAGLQRALEILQEEDLIDEDDIPVRSFFPENWLWRVETVDRFQILTLWLP   800
|||||||||||||||||||||||||||||||||||||||||||||||||   751
QAGLQRALEILQEEDLIDEDDIPVRSFFPENWLWRVETVDRFQILTLWLP   800 . . . 801

DSLTTWEIHGLSLSKTKG                                  818
||||||||||||||||||                                  801
DSLTTWEIHGLSLSKTKG                                  818
```

Sequence name: CO4_HUMAN (SEQ ID NO:485)

Sequence documentation:

Alignment of: HSCOC4_PEA.sub.--1_P6 (SEQ ID NO:490).times.CO4_HUMAN (SEQ ID NO:485).

Alignment segment 1/1: TABLE-US-00847 Quality: 10211.00 Escore: 0 Matching length: 1052 Total length: 1052 Matching Percent 100.00 Matching Percent 100.00 Similarity: Identity: Total Percent Similarity: 100.00 Total Percent Identity: 100.00 Gaps: 0

```
Alignment TABLE-US-00848 . . . 1
MRLLWGLIWASSFETLSLQKPRLLLFSPSVVHLGVPLSVGVQLQDVPRGQ   50
||||||||||||||| |||||||||||||||||||||||||||||||||    1
MRLLWGLIWASSFFTLSLQKPRLLLFSPSVVHLGVPLSVGVQLQDVPRGQ   50 . . . 51

VVKGSVFLRNPSRNNVPCSPKVDFTLSSERDFALLSLQVPLKDAKSCGLH   100
|||||||||||||||||||||||||||||||||||||||||||||||||    51
VVKGSVFLRNPSRNNVPCSPKVDFTLSSERDFALLSLQVPLKDAKSCGLH   100 . . . 101

QLLRGPEVQLVAHSPWLKDSLSRTTNIQGINLLFSSRRGHLFLQTDQPIY   150
|||||||||||||||||||||||||||||||||||||||||||||||||   101
QLLRGPEVQLVAHSPWLKDSLSRTTNIQGINLLFSSRRGHLFLQTDQPIY   150 . . . 151

NPGQRVRYRVFALDQKMRPSTDTITVMVENSHGLRVRKKEVYMPSSIFQD   200
|||||||||||||||||||||||||||||||||||||||||||||||||   151
NPGQRVRYRVFALDQKMRPSTDTITVMVENSHGLRVRKKEVYMPSSIFQD   200 . . . 201
```

-continued

```
                                                          250
DFVIPDISEPGTWKISARFSDGLESNSSTQFEVKKYVLPNFEVKITPGKP
|||||||||||||||||||||||||||||||||||||||||||||||||         201
DFVIPDISEPGTWKISARFSDGLESNSSTQFEVKKYVLPNFEVKITPGKP        250 ... 251

YILTVPGHLDEMQLDIQARYIYGKPVQGVAYVRFGLLDEDGKKTFFRGLE        300
|||||||||||||||||||||||||||||||||||||||||||||||||         251
YILTVPGHLDEMQLDIQARYIYGKPVQGVAYVRFGLLDEDGKKTFFRGLE        300 ... 301

SQTKLVNGQSHISLSKAEFQDALEKLNMGITDLQGLRLYVAAAIIESPGG        350
|||||||||||||||||||||||||||||||||||||||||||||||||         301
SQTKLVNGQSHISLSKAEFQDALEKLNMGITDLQGLRLYVAAAIIESPGG        350 ... 351

EMEEAELTSWYFVSSPFSLDLSKTKRHLVPGAPFLLQALVREMSGSPASG        400
|||||||||||||||||||||||||||||||||||||||||||||||||         351
EMEEAELTSWYFVSSPFSLDLSKTKRHLVPGAPFLLQALVREMSGSPASG        400 ... 401

IPVKVSATVSSPGSVPEVQDIQQNTDGSGQVSIPIIIPQTISELQLSVSA        450
|||||||||||||||||||||||||||||||||||||||||||||||||         401
IPVKVSATVSSPGSVPEVQDIQQNTDGSGQVSIPIIIPQTISELQLSVSA        450 ... 451

GSPHPAIARLTVAAPPSGGPGFLSIERPDSRPPRVGDTLNLNLRAVGSGA        500
|||||||||||||||||||||||||||||||||||||||||||||||||         451
GSPHPAIARLTVAAPPSGGPGFLSIERPDSRPPRVGDTLNLNLRAVGSGA        500 ... 501

TFSHYYYMILSRGQIVFMNREPKRTLTSVSVFVDHHLAPSFYFVAFYYHG        550
|||||||||||||||||||||||||||||||||||||||||||||||||         501
TFSHYYYMILSRGQIVFMNREPKRTLTSVSVFVDHHLAPSFYFVAFYYHG        550 ... 551

DHPVANSLRVDVQAGACEGKLELSVDGAKQYRNGESVKLHLETDSLALVA        600
|||||||||||||||||||||||||||||||||||||||||||||||||         551
DHPVANSLRVDVQAGACEGKLELSVDGAKQYRNGESVKLHLETDSLALVA        600 ... 601

LGALDTALYAAGSKSHKPLNMGKVFEAMNSYDLGCGPGGGDSALQVFQAA        650
|||||||||||||||||||||||||||||||||||||||||||||||||         601
LGALDTALYAAGSKSHKPLNMGKVFEAMNSYDLGCGPGGGDSALQVFQAA        650 ... 651

GLAFSDGDQWTLSRKRLSCPKEKTTRKKRNVNFQKAINEKLGQYASPTAK        700
|||||||||||||||||||||||||||||||||||||||||||||||||         651
GLAFSDGDQWTLSRKRLSCPKEKTTRKKRNVNFQKAINEKLGQYASPTAK        700 ... 701

RCCQDGVTRLPMMRSCEQRAARVQQPDCREPFLSCCQFAESLRKKSRDKG        750
|||||||||||||||||||||||||||||||||||||||||||||||||         701
RCCQDGVTRLPMMRSCEQRAARVQQPDCREPFLSCCQFAESLRKKSRDKG        750 ... 751

QAGLQRALEILQEEDLIDEDDIPVRSFFPENWLWRVETVDRFQILTLWLP        800
|||||||||||||||||||||||||||||||||||||||||||||||||         751
QAGLQRALEILQEEDLIDEDDIPVRSFFPENWLWRVETVDRFQILTLWLP        800 ... 801

DSLTTWEIHGLSLSKTKGLCVATPVQLRVEREFHLHLRLPMSVRRFEQLE        850
|||||||||||||||||||||||||||||||||||||||||||||||||         801
DSLTTWEIHGLSLSKTKGLCVATPVQLRVEREFHLHLRLPMSVRRFEQLE        850 ... 851

LRPVLYNYLDKNLTVSVHVSPVEGLCLAGGGGLAQQVLVPAGSARPVAFS        900
|||||||||||||||||||||||||||||||||||||||||||||||||         851
LRPVLYNYLDKNLTVSVHVSPVEGLCLAGGGGLAQQVLVPAGSARPVAFS        900 ... 901

VVPTAAAAVSLKVVARGSFEFPVGDAVSKVLQIEKEGAIHREELVYELNP        950
|||||||||||||||||||||||||||||||||||||||||||||||||         901
VVPTAAAAVSLKVVARGSFEFPVGDAVSKVLQIEKEGAIHREELVYELNP        950 ... 951

LDHRGRTLEIPGNSDPNMIPDGDFNSYVRVTASDPLDTLGSEGALSPGGV        1000
|||||||||||||||||||||||||||||||||||||||||||||||||         951
LDHRGRTLEIPGNSDPNMIPDGDFNSYVRVTASDPLDTLGSEGALSPGGV        1000 ... 1001

ASLLRLPRGCGEQTMIYLAPTLAASRYLDKTEQWSTLPPETKDHAVDLIQ        1050
|||||||||||||||||||||||||||||||||||||||||||||||||         1001
ASLLRLPRGCGEQTMIYLAPTLAASRYLDKTEQWSTLPPETKDHAVDLIQ        1050 1051

KG                                                        1052
||                                                        1051
KG                                                        1052
```

Sequence name: CO4_HUMAN_V1 (SEQ ID NO:486)
Sequence documentation:

Alignment of: HSCOC4_PEA.sub.--1_P12 (SEQ ID NO:491).times.CO4_HUMAN_V1 (SEQ ID NO:486).

Alignment segment 1/1: TABLE-US-00849 Quality: 13367.00 Escore: 0 Matching length: 1380 Total length: 1380 Matching Percent 100.00 Matching Percent 100.00 Similarity: Identity: Total Percent Similarity: 100.00 Total Percent Identity: 100.00 Gaps: 0

```
Alignment: TABLE-US-00850 . . . 1
MRLLWGLIWASSFFTLSLQKPRLLLFSPSVVHLGVPLSVGVQLQDVPRGQ           50
||||||||||||||||||||||||||||||||||||||||||||||||||           1
MRLLWGLIWASSFFTLSLQKPRLLLFSPSVVHLGVPLSVGVQLQDVPRGQ           50 . . . 51

VVKGSVFLRNPSRNNVPCSPKVDFTLSSERDFALLSLQVPLKDAKSCGLH          100
||||||||||||||||||||||||||||||||||||||||||||||||||           51
VVKGSVFLRNPSRNNVPCSPKVDFTLSSERDFALLSLQVPLKDAKSCGLH          100 . . . 101

QLLRGPEVQLVAHSPWLKDSLSRTTNIQGINLLFSSRRGHLFLQTDQPIY          150
||||||||||||||||||||||||||||||||||||||||||||||||||          101
QLLRGPEVQLVAHSPWLKDSLSRTTNIQGINLLFSSRRGHLFLQTDQPIY          150 . . . 151

NPGQRVRYRVFALDQKMRPSTDTITVMVENSHGLRVRKKEVYMPSSIFQD          200
||||||||||||||||||||||||||||||||||||||||||||||||||          151
NPGQRVRYRVFALDQKMRPSTDTITVMVENSHGLRVRKKEVYMPSSIFQD          200 . . . 201

DFVIPDISEPGTWKISARFSDGLESNSSTQFEVKKYVLPNFEVKITPGKP          250
||||||||||||||||||||||||||||||||||||||||||||||||||          201
DFVIPDISEPGTWKISARFSDGLESNSSTQFEVKKYVLPNFEVKITPGKP          250 . . . 251

YILTVPGHLDEMQLDIQARYIYGKPVQGVAYVRFGLLDEDGKKTFFRGLE          300
||||||||||||||||||||||||||||||||||||||||||||||||||          251
YILTVPGHLDEMQLDIQARYIYGKPVQGVAYVRFGLLDEDGKKTFFRGLE          300 . . . 301

SQTKLVNGQSHISLSKAEFQDALEKLNMGITDLQGLRLYVAAAIIESPGG          350
||||||||||||||||||||||||||||||||||||||||||||||||||          301
SQTKLVNGQSHISLSKAEFQDALEKLNMGITDLQGLRLYVAAAIIESPGG          350 . . . 351

EMEEAELTSWYFVSSPFSLDLSKTKRHLVPGAPFLLQALVREMSGSPASG          400
||||||||||||||||||||||||||||||||||||||||||||||||||          351
EMEEAELTSWYFVSSPFSLDLSKTKRHLVPGAPFLLQALVREMSGSPASG          400 . . . 401

IPVKVSATVSSPGSVPEVQDIQQNTDGSGQVSIPIIIPQTISELQLSVSA          450
||||||||||||||||||||||||||||||||||||||||||||||||||          401
IPVKVSATVSSPGSVPEVQDIQQNTDGSGQVSIPIIIPQTISELQLSVSA          450 . . . 451

GSPHPAIARLTVAAPPSGGPGFLSIERPDSRPPRVGDTLNLNLRAVGSGA          500
||||||||||||||||||||||||||||||||||||||||||||||||||          451
GSPHPAIARLTVAAPPSGGPGFLSIERPDSRPPRVGDTLNLNLRAVGSGA          500 . . . 501

TFSHYYYMILSRGQIVFMNREPKRTLTSVSVFVDHHLAPSFYFVAFYYHG          550
||||||||||||||||||||||||||||||||||||||||||||||||||          501
TFSHYYYMILSRGQIVFMNREPKRTLTSVSVFVDHHLAPSFYFVAFYYHG          550 . . . 551

DHPVANSLRVDVQAGACEGKLELSVDGAKQYRNGESVKLHLETDSLALVA          600
||||||||||||||||||||||||||||||||||||||||||||||||||          551
DHPVANSLRVDVQAGACEGKLELSVDGAKQYRNGESVKLHLETDSLALVA          600 . . . 601

LGALDTALYAAGSKSHKPLNMGKVFEAMNSYDLGCGPGGGDSALQVFQAA          650
||||||||||||||||||||||||||||||||||||||||||||||||||          601
LGALDTALYAAGSKSHKPLNMGKVFEAMNSYDLGCGPGGGDSALQVFQAA          650 . . . 651

GLAFSDGDQWTLSRKRLSCPKEKTTRKKRNVNFQKAINEKLGQYASPTAK          700
||||||||||||||||||||||||||||||||||||||||||||||||||          651
GLAFSDGDQWTLSRKRLSCPKEKTTRKKRNVNFQKAINEKLGQYASPTAK          700 . . . 701

RCCQDGVTRLPMMRSCEQRAARVQQPDCREPFLSCCQFAESLRKKSRDKG          750
||||||||||||||||||||||||||||||||||||||||||||||||||          701
RCCQDGVTRLPMMRSCEQRAARVQQPDCREPFLSCCQFAESLRKKSRDKG          750 . . . 751

QAGLQRALEILQEEDLIDEDDIPVRSFFPENWLWRVETVDRFQILTLWLP          800
||||||||||||||||||||||||||||||||||||||||||||||||||          751
QAGLQRALEILQEEDLIDEDDIPVRSFFPENWLWRVETVDRFQILTLWLP          800 . . . 801

DSLTTWEIHGLSLSKTKGLCVATPVQLRVFREFHLHLRLPMSVRRFEQLE          850
||||||||||||||||||||||||||||||||||||||||||||||||||          801
DSLTTWEIHGLSLSKTKGLCVATPVQLRVFREFHLHLRLPMSVRRFEQLE          850 . . . 851

LRPVLYNYLDKNLTVSVHVSPVEGLCLAGGGGLAQQVLVPAGSARPVAFS          900
||||||||||||||||||||||||||||||||||||||||||||||||||          851
LRPVLYNYLDKNLTVSVHVSPVEGLCLAGGGGLAQQVLVPAGSARPVAFS          900 . . . 901

VVPTAAAAVSLKVVARGSFEFPVGDAVSKVLQIEKEGAIHREELVYELNP          950
||||||||||||||||||||||||||||||||||||||||||||||||||          901
VVPTAAAAVSLKVVARGSFEFPVGDAVSKVLQIEKEGAIHREELVYELNP          950 . . . 951

LDHRGRTLEIPGNSDPNMIPDGDFNSYVRVTASDPLDTLGSEGALSPGGV         1000
||||||||||||||||||||||||||||||||||||||||||||||||||          951
LDHRGRTLEIPGNSDPNMIPDGDFNSYVRVTASDPLDTLGSEGALSPGGV         1000 . . . 1001
```

-continued

```
ASLLRLPRGCGEQTMIYLAPTLAASRYLDKTEQWSTLPPETKDHAVDLIQ   1050
||||||||||||||||||||||||||||||||||||||||||||||||||   1001
ASLLRLPRGCGEQTMIYLAPTLAASRYLDKTEQWSTLPPETKDHAVDLIQ   1050 . . . 1051

KGYMRIQQFRKADGSYAAWLSRDSSTNLTAFVLKVLSLAQEQVGGSPEKL   1100
||||||||||||||||||||||||||||||||||||||||||||||||||   1051
KGYMRIQQFRKADGSYAAWLSRDSSTNLTAFVLKVLSLAQEQVGGSPEKL   1100 . . . 1101

QETSNWLLSQQQADGSFQDPCPVLDRSMQGGLVGNDETVALTAFVTIALH   1150
||||||||||||||||||||||||||||||||||||||||||||||||||   1101
QETSNWLLSQQQADGSFQDPCPVLDRSMQGGLVGNDETVALTAFVTIALH   1150 . . . 1151

HGLAVFQDEGAEPLKQRVEASISKASSFLGEKASAGLLGAHAAAITAYAL   1200
||||||||||||||||||||||||||||||||||||||||||||||||||   1151
HGLAVFQDEGAEPLKQRVEASISKASSFLGEKASAGLLGAHAAAITAYAL   1200 . . . 1201

TLTKAPADLRGVAHNNLMAMAQETGDNLYWGSVTGSQSNAVSPTPAPRNP   1250
||||||||||||||||||||||||||||||||||||||||||||||||||   1201
TLTKAPADLRGVAHNNLMAMAQETGDNLYWGSVTGSQSNAVSPTPAPRNP   1250 . . . 1251

SDPMPQAPALWIETTAYALLHLLLHEGKAEMADQAAAWLTRQGSFQGGFR   1300
||||||||||||||||||||||||||||||||||||||||||||||||||   1251
SDPMPQAPALWIETTAYALLHLLLHEGKAEMADQAAAWLTRQGSFQGGFR   1300 . . . 1301

STQDTVIALDALSAYWIASHTTEERGLNVTLSSTGRNGFKSHALQLNNRQ   1350
||||||||||||||||||||||||||||||||||||||||||||||||||   1301
STQDTVIALDALSAYWIASHTTEERGLNVTLSSTGRNGFKSHALQLNNRQ   1350 . . . 1351

IRGLEEELQFSLGSKINVKVGGNSKGTLKV                       1380
||||||||||||||||||||||||||||||                       1351
IRGLEEELQFSLGSKINVKVGGNSKGTLKV                       1380
```

Sequence name: CO4_HUMAN_V1 (SEQ ID NO:486)

Sequence documentation:

Alignment of: HSCOC4_PEA.sub.--1_P15 (SEQ ID NO:492).times.CO4_HUMAN_V1 (SEQ ID NO:486).

Alignment segment 1/1: TABLE-US-00851 Quality: 13174.00 Escore: 0 Matching length: 1359 Total length: 1359 Matching Percent 100.00 Matching Percent 100.00 Similarity: Identity: Total Percent Similarity: 100.00 Total Percent Identity: 100.00 Gaps: 0

```
Alignment TABLE-US-00852 . . . 1
MRLLWGLIWASSFFTLSLQKPRLLLFSPSVVHLGVPLSVGVQLQDVPRGQ   50
|||||||||||||||||||||||||||||||||||||||||||||||||   1
MRLLWGLIWASSFFTLSLQKPRLLLFSPSVVHLGVPLSVGVQLQDVPRGQ   50 . . . 51

VVKGSVFLRNPSRNNVPCSPKVDFTLSSERDFALLSLQVPLKDAKSCGLH   100
|||||||||||||||||||||||||||||||||||||||||||||||||   51
VVKGSVFLRNPSRNNVPCSPKVDFTLSSERDFALLSLQVPLKDAKSCGLH   100 . . . 101

QLLRGPEVQLVAHSPWLKDSLSRTTNIQGINLLFSSRRGHLFLQTDQPIY   150
|||||||||||||||||||||||||||||||||||||||||||||||||   101
QLLRGPEVQLVAHSPWLKDSLSRTTNIQGINLLFSSRRGHLFLQTDQPIY   150 . . . 151

NPGQRVRYRVFALDQKMRPSTDTITVMVENSHGLRVRKKEVYMPSSIFQD   200
|||||||||||||||||||||||||||||||||||||||||||||||||   151
NPGQRVRYRVFALDQKMRPSTDTITVMVENSHGLRVRKKEVYMPSSIFQD   200 . . . 201

DFVIPDISEPGTWKISARFSDGLESNSSTQFEVKKYVLPNFEVKITPGKP   250
|||||||||||||||||||||||||||||||||||||||||||||||||   201
DFVIPDISEPGTWKISARFSDGLESNSSTQFEVKKYVLPNFEVKITPGKP   250 . . . 251

YILTVPGHLDEMQLDIQARYIYGKPVQGVAYVRFGLLDEDGKKTFFRGLE   300
|||||||||||||||||||||||||||||||||||||||||||||||||   251
YILTVPGHLDEMQLDIQARYIYGKPVQGVAYVRFGLLDEDGKKTFFRGLE   300 . . . 301

SQTKLVNGQSHISLSKAEFQDALEKLNMGITDLQGLRLYVAAAIIESPGG   350
|||||||||||||||||||||||||||||||||||||||||||||||||   301
SQTKLVNGQSHISLSKAEFQDALEKLNMGITDLQGLRLYVAAAIIESPGG   350 . . . 351

EMEEAELTSWYFVSSPFSLDLSKTKRHLVPGAPFLLQALVREMSGSPASG   400
|||||||||||||||||||||||||||||||||||||||||||||||||   351
EMEEAELTSWYFVSSPFSLDLSKTKRHLVPGAPFLLQALVREMSGSPASG   400 . . . 401

IPVKVSATVSSPGSVPEVQDIQQNTDGSGQVSIPIIIPQTISELQLSVSA   450
|||||||||||||||||||||||||||||||||||||||||||||||||   401
IPVKVSATVSSPGSVPEVQDIQQNTDGSGQVSIPIIIPQTISELQLSVSA   450 . . . 451
```

```
                      -continued
GSPHPAIARLTVAAPPSGGPGFLSIERPDSRPPRVGDTLNLNLRAVGSGA    500
||||||||||||||||||||||||||||||||||||||||||||||||||    451
GSPHPAIARLTVAAPPSGGPGFLSIERPDSRPPRVGDTLNLNLRAVGSGA    500 . . . 501

TFSHYYYMILSRGQIVFMNREPKRTLTSVSVFVDHHLAPSFYFVAFYYHG    550
||||||||||||||||||||||||||||||||||||||||||||||||||    501
TFSHYYYMILSRGQIVFMNREPKRTLTSVSVFVDHHLAPSFYFVAFYYHG    550 . . . 551

DHPVANSLRVDVQAGACEGKLELSVDGAKQYRNGESVKLHLETDSLALVA    600
||||||||||||||||||||||||||||||||||||||||||||||||||    551
DHPVANSLRVDVQAGACEGKLELSVDGAKQYRNGESVKLHLETDSLALVA    600 . . . 601

LGALDTALYAAGSKSHKPLNMGKVFEAMNSYDLGCGPGGGDSALQVFQAA    650
||||||||||||||||||||||||||||||||||||||||||||||||||    601
LGALDTALYAAGSKSHKPLNMGKVFEAMNSYDLGCGPGGGDSALQVFQAA    650 . . . 651

GLAFSDGDQWTLSRKRLSCPKEKTTRKKRNVNFQKAINEKLGQYASPTAK    700
||||||||||||||||||||||||||||||||||||||||||||||||||    651
GLAFSDGDQWTLSRKRLSCPKEKTTRKKRNVNFQKAINEKLGQYASPTAK    700 . . . 701

RCCQDGVTRLPMMRSCEQRAARVQQPDCREPFLSCCQFAESLRKKSRDKG    750
||||||||||||||||||||||||||||||||||||||||||||||||||    701
RCCQDGVTRLPMMRSCEQRAARVQQPDCREPFLSCCQFAESLRKKSRDKG    750 . . . 751

QAGLQRALEILQEEDLIDEDDIPVRSFFPENWLWRVETVDRFQILTLWLP    800
||||||||||||||||||||||||||||||||||||||||||||||||||    751
QAGLQRALEILQEEDLIDEDDIPVRSFFPENWLWRVETVDRFQILTLWLP    800 . . . 801

DSLTTWEIHGLSLSKTKGLCVATPVQLRVFREFHLHLRLPMSVRRFEQLE    850
||||||||||||||||||||||||||||||||||||||||||||||||||    801
DSLTTWEIHGLSLSKTKGLCVATPVQLRVFREFHLHLRLPMSVRRFEQLE    850 . . . 851

LRPVLYNYLDKNLTVSVHVSPVEGLCLAGGGGLAQQVLVPAGSARPVAFS    900
||||||||||||||||||||||||||||||||||||||||||||||||||    851
LRPVLYNYLDKNLTVSVHVSPVEGLCLAGGGGLAQQVLVPAGSARPVAFS    900 . . . 901

VVPTAAAAVSLKVVARGSFEFPVGDAVSKVLQIEKEGAIHREELVYELNP    950
||||||||||||||||||||||||||||||||||||||||||||||||||    901
VVPTAAAAVSLKVVARGSFEFPVGDAVSKVLQIEKEGAIHREELVYELNP    950 . . . 951

LDHRGRTLEIPGNSDPNMIPDGDFNSYVRVTASDPLDTLGSEGALSPGGV    1000
||||||||||||||||||||||||||||||||||||||||||||||||||    951
LDHRGRTLEIPGNSDPNMIPDGDFNSYVRVTASDPLDTLGSEGALSPGGV    1000 . . . 1001

ASLLRLPRGCGEQTMIYLAPTLAASRYLDKTEQWSTLPPETKDHAVDLTQ    1050
||||||||||||||||||||||||||||||||||||||||||||||||||    1001
ASLLRLPRGCGEQTMIYLAPTLAASRYLDKTEQWSTLPPETKDHAVDLIQ    1050 . . . 1051

KGYMRIQQFRKADGSYAAWLSRDSSTVLTAFVLKVLSLAQEQVGGSPEKL    1100
||||||||||||||||||||||||||||||||||||||||||||||||||    1051
KGYMRIQQFRKADGSYAAWLSRDSSTWLTAFVLKVLSLAQEQVGGSPEKL    1100 . . . 1101

QETSNWLLSQQQADGSFQDPCPVLDRSMQGGLVGNDETVALTAFVTIALH    1150
||||||||||||||||||||||||||||||||||||||||||||||||||    1101
QETSNWLLSQQQADGSFQDPCPVLDRSMQGGLVGNDETVALTAFVTIALH    1150 . . . 1151

HGLAVFQDEGAEPLKQRVEASISKASSFLGEKASAGLLGAHAAAITAYAL    1200
||||||||||||||||||||||||||||||||||||||||||||||||||    1151
HGLAVFQDEGAEPLKQRVEASISKASSFLGEKASAGLLGAHAAAITAYAL    1200 . . . 1201

TLTKAPADLRGVAHNNLMAMAQETGDNLYWGSVTGSQSNAVSPTPAPRNP    1250
||||||||||||||||||||||||||||||||||||||||||||||||||    1201
TLTKAPADLRGVAHNNLMAMAQETGDNLYWGSVTGSQSNAVSPTPAPRNP    1250 . . . 1251

SDPMPQAPALWIETTAYALLHLLLHEGKAEMADQAAAWLTRQGSFQGGFR    1300
||||||||||||||||||||||||||||||||||||||||||||||||||    1251
SDPMPQAPALWIETTAYALLHLLLHEGKAEMADQAAAWLTRQGSFQGGFR    1300 . . . 1301

STQDTVIALDALSAYWIASHTTEERGLNVTLSSTGRNGFKSHALQLNNRQ    1350
||||||||||||||||||||||||||||||||||||||||||||||||||    1301
STQDTVIALDALSAYWIASHTTEERGLNVTLSSTGRNGFKSHALQLNNRQ    1350 . . . 1351

IRGLEEELQ                                            1359
|||||||||                                            1351
IRGLEEELQ                                            1359
```

Sequence name: CO4_HUMAN_V1 (SEQ ID NO:486)

Sequence documentation:

Alignment of: HSCOC4_PEA.sub.--1_P16 (SEQ ID NO:493).times.CO4_HUMAN_V1 (SEQ ID NO:486).

Alignment segment 1/1: TABLE-US-00853 Quality: 14137.00 Escore: 0 Matching length: 1457 Total length: 1457 Matching Percent 100.00 Matching Percent 100.00 Similarity: Identity: Total Percent Similarity: 100.00 Total Percent Identity: 100.00 Gaps: 0

```
Alignment TABLE-US-00854 . . . 1
MRLLWGLIWASSFFTLSLQKPRLLLFSPSVVHLGVPLSVGVQLQDVPRGQ      50
||||||||||||||||||||||||||||||||||||||||||||||||||     1
MRLLWGLIWASSFFTLSLQKPRLLLFSPSVVHLGVPLSVGVQLQDVPRGQ      50  . . .   51

VVKGSVFLRNPSRNNVPCSPKVDFTLSSERDFALLSLQVPLKDAKSCGLH      100
||||||||||||||||||||||||||||||||||||||||||||||||||     51
VVKGSVFLRNPSRNNVPCSPKVDFTLSSERDFALLSLQVPLKDAKSCGLH      100 . . .  101

QLLRGPEVQLVAHSPWLKDSLSRTTNIQGINLLFSSRRGHLFLQTDQPIY      150
||||||||||||||||||||||||||||||||||||||||||||||||||     101
QLLRGPEVQLVAHSPWLKDSLSRTTNIQGINLLFSSRRGHLFLQTDQPIY      150 . . .  151

NPGQRVRYRVFALDQKMRPSTDTITVMVENSHGLRVRKKEVYMPSSIFQD      200
||||||||||||||||||||||||||||||||||||||||||||||||||     151
NPGQRVRYRVFALDQKMRPSTDTITVMVENSHGLRVRKKEVYMPSSIFQD      200 . . .  201

DFVIPDISEPGTWKISARFSDGLESNSSTQFEVKKYVLPNFEVKITPGKP      250
||||||||||||||||||||||||||||||||||||||||||||||||||     201
DFVIPDISEPGTWKISARFSDGLESNSSTQFEVKKYVLPNFEVKITPGKP      250 . . .  251

YILTVPGHLDEMQLDIQARYIYGKPVQGVAYVRFGLLDEDGKKTFFRGLE      300
||||||||||||||||||||||||||||||||||||||||||||||||||     251
YILTVPGHLDEMQLDIQARYIYGKPVQGVAYVRFGLLDEDGKKTFFRGLE      300 . . .  301

SQTKLVNGQSHISLSKAEFQDALEKLNMGITDLQGLRLYVAAAIIESPGG      350
||||||||||||||||||||||||||||||||||||||||||||||||||     301
SQTKLVNGQSHISLSKAEFQDALEKLNMGITDLQGLRLYVAAAIIESPGG      350 . . .  351

EMEEAELTSWYFVSSPFSLDLSKTKRHLVPGAPFLLQALVREMSGSPASG      400
||||||||||||||||||||||||||||||||||||||||||||||||||     351
EMEEAELTSWYFVSSPFSLDLSKTKRHLVPGAPFLLQALVREMSGSPASG      400 . . .  401

IPVKVSATVSSPGSVPEVQDIQQNTDGSGQVSIPIIIPQTISELQLSVSA      450
||||||||||||||||||||||||||||||||||||||||||||||||||     401
IPVKVSATVSSPGSVPEVQDIQQNTDGSGQVSIPIIIPQTISELQLSVSA      450 . . .  451

GSPHPAIARLTVAAPPSGGPGFLSIERPDSRPPRVGDTLNLNLRAVGSGA      500
||||||||||||||||||||||||||||||||||||||||||||||||||     451
GSPHPAIARLTVAAPPSGGPGFLSIERPDSRPPRVGDTLNLNLRAVGSGA      500 . . .  501

TFSHYYYMILSRGQIVFMNREPKRTLTSVSVFVDHHLAPSFYFVAFYYHG      550
||||||||||||||||||||||||||||||||||||||||||||||||||     501
TFSHYYYMILSRGQIVFMNREPKRTLTSVSVFVDHHLAPSFYFVAFYYHG      550 . . .  551

DHPVANSLRVDVQAGACEGKLELSVDGAKQYRNGESVKLHLETDSLALVA      600
||||||||||||||||||||||||||||||||||||||||||||||||||     551
DHPVANSLRVDVQAGACEGKLELSVDGAKQYRNGESVKLHLETDSLALVA      600 . . .  601

LGALDTALYAAGSKSHKPLNMGKVFEAMNSYDLGCGPGGGDSALQVFQAA      650
||||||||||||||||||||||||||||||||||||||||||||||||||     601
LGALDTALYAAGSKSHKPLNMGKVFEAMNSYDLGCGPGGGDSALQVFQAA      650 . . .  651

GLAFSDGDQWTLSRKRLSCPKEKTTRKKRNVNFQKAINEKLGQYASPTAK      700
||||||||||||||||||||||||||||||||||||||||||||||||||     651
GLAFSDGDQWTLSRKRLSCPKEKTTRKKRNVNFQKAINEKLGQYASPTAK      700 . . .  701

RCCQDGVTRLPMMRSCEQRAARVQQPDCREPFLSCCQFAESLRKKSRDKG      750
||||||||||||||||||||||||||||||||||||||||||||||||||     701
RCCQDGVTRLPMMRSCEQRAARVQQPDCREPFLSCCQFAESLRKKSRDKG      750 . . .  751

QAGLQRALEILQEEDLIDEDDIPVRSFFPENWLWRVETVDRFQILTLWLP      800
||||||||||||||||||||||||||||||||||||||||||||||||||     751
QAGLQRALEILQEEDLIDEDDIPVRSFFPENWLWRVETVDRFQILTLWLP      800 . . .  801

DSLTTWEIHGLSLSKTKGLCVATPVQLRVFREFHLHLRLPMSVRRFEQLE      850
||||||||||||||||||||||||||||||||||||||||||||||||||     801
DSLTTWEIHGLSLSKTKGLCVATPVQLRVFREFHLHLRLPMSVRRFEQLE      850 . . .  851

LRPVLYNYLDKNLTVSVHVSPVEGLCLAGGGGLAQQVLVPAGSARPVAFS      900
||||||||||||||||||||||||||||||||||||||||||||||||||     851
LRPVLYNYLDKNLTVSVHVSPVEGLCLAGGGGLAQQVLVPAGSARPVAFS      900 . . .  901
```

```
                                    -continued
VVPTAAAAVSLKVVARGSFEFPVGDAVSKVLQIEKEGAIHREELVYELNP     950
||||||||||||||||||||||||||||||||||||||||||||||||||
                                                       901
VVPTAAAAVSLKVVARGSFEFPVGDAVSKVLQIEKEGAIHREELVYELNP     950 . . . 951

LDHRGRTLEIPGNSDPNMIPDGDFNSYVRVTASDPLDTLGSEGALSPGGV    1000
||||||||||||||||||||||||||||||||||||||||||||||||||
                                                       951
LDHRGRTLEIPGNSDPNMIPDGDFNSYVRVTASDPLDTLGSEGALSPGGV    1000 . . . 1001

ASLLRLPRGCGEQTMIYLAPTLAASRYLDKTEQWSTLPPETKDHAVDLIQ    1050
||||||||||||||||||||||||||||||||||||||||||||||||||
                                                      1001
ASLLRLPRGCGEQTMIYLAPTLAASRYLDKTEQWSTLPPETKDHAVDLIQ    1050 . . . 1051

KGYMRIQQFRKADGSYAAWLSRDSSTWLTAFVLKVLSLAQEQVGGSPEKL    1100
||||||||||||||||||||||||||||||||||||||||||||||||||
                                                      1051
KGYMRIQQFRKADGSYAAWLSRDSSTWLTAFVLKVLSLAQEQVGGSPEKL    1100 . . . 1101

QETSNWLLSQQQADGSFQDPCPVLDRSMQGGLVGNDETVALTAFVTIALH    1150
||||||||||||||||||||||||||||||||||||||||||||||||||
                                                      1101
QETSNWLLSQQQADGSFQDPCPVLDRSMQGGLVGNDETVALTAFVTIALH    1150 . . . 1151

HGLAVFQDEGAEPLKQRVEASISKASSFLGEKASAGLLGAHAAAITAYAL    1200
||||||||||||||||||||||||||||||||||||||||||||||||||
                                                      1151
HGLAVFQDEGAEPLKQRVEASISKASSFLGEKASAGLLGAHAAAITAYAL    1200 . . . 1201

TLTKAPADLRGVAHNNLMAMAQETGDNLYWGSVTGSQSNAVSPTPAPRNP    1250
||||||||||||||||||||||||||||||||||||||||||||||||||
                                                      1201
TLTKAPADLRGVAHNNLMAMAQETGDNLYWGSVTGSQSNAVSPTPAPRNP    1250 . . . 1251

SDPMPQAPALWIETTAYALLHLLLHEGKAEMADQAAAWLTRQGSFQGGFR    1300
||||||||||||||||||||||||||||||||||||||||||||||||||
                                                      1251
SDPMPQAPALWIETTAYALLHLLLHEGKAEMADQAAAWLTRQGSFQGGFR    1300 . . . 1301

STQDTVIALDALSAYWIASHTTEERGLNVTLSSTGRNGFKSHALQLNNRQ    1350
||||||||||||||||||||||||||||||||||||||||||||||||||
                                                      1301
STQDTVIALDALSAYWIASHTTEERGLNVTLSSTGRNGFKSHALQLNNRQ    1350 . . . 1351

IRGLEEELQFSLGSKINVKVGGNSKGTLKVLRTYNVLDMKNTTCQDLQIE    1400
||||||||||||||||||||||||||||||||||||||||||||||||||
                                                      1351
IRGLEEELQFSLGSKINVKVGGNSKGTLKVLRTYNVLDMKNTTCQDLQIE    1400 . . . 1401

VTVKGHVEYTMEANEDYEDYEYDELPAKDDPDAPLQPVTPLQLFEGRRNR    1450
||||||||||||||||||||||||||||||||||||||||||||||||||
                                                      1401
VTVKGHVEYTMEANEDYEDYEYDELPAKDDPDAPLQPVTPLQLFEGRRNR    1450 . . . 1451

RRREAPK                                               1457
|||||||
                                                      1451
RRREAPK                                               1457
```

Sequence name: CO4_HUMAN_V1 (SEQ ID NO:486)

Sequence documentation:

Alignment of: HSCOC4_PEA.sub.--1_P20 (SEQ ID NO:494).times.CO4_HUMAN_V1 (SEQ ID NO:486).

Alignment segment 1/1: TABLE-US-00855 Quality: 12641.00 Escore: 0 Matching length: 1303 Total length: 1303 Matching Percent Identity: 100.00 Matching Percent Similarity: 100.00 Total Percent Similarity: 100.00 Total Percent Identity: 100.00 Gaps: 0

```
               Alignment TABLE-US-00856 . . . 1
               MRLLWGLIWASSFFTLSLQKPRLLLFSPSVVHLGVPLSVGVQLQDVPRGQ     50
               ||||||||||||||||||||||||||||||||||||||||||||||||||
                                                                        1
               MRLLWGLIWASSFFTLSLQKPRLLLFSPSVVHLGVPLSVGVQLQDVPRGQ     50 . . . 51

VVKCSVFLRNPSRNNVPCSPKVDFTLSSERDFALLSLQVPLKDAKSCGLH    100
               |||.||||||||||||||||||||||||||||||||||||||||||||||
                                                                       51
               VVKGSVFLRNPSRNNVPCSPKVDFTLSSERDFALLSLQVPLKDAKSCGLH    100 . . . 101

QLLRGPEVQLVAHSPWLKDSLSRTTNIQGINLLFSSRRGHLFLQTDQPIY    150
               ||||||||||||||||||||||||||||||||||||||||||||||||||
                                                                      101
               QLLRGPEVQLVAHSPWLKDSLSRTTNIQGINLLFSSRRGHLFLQTDQPIY    150 . . . 151

NPGQRVRYRVFALDQKMRPSTDTITVMVENSHGLRVRKKEVYMPSSIFQD    200
               ||||||||||||||||||||||||||||||||||||||||||||||||||
                                                                      151
               NPGQRVRYRVFALDQKMRPSTDTITVMVENSHGLRVRKKEVYMPSSIFQD    200 . . . 201

DFVIPDISEPGTWKISARFSDGLESNSSTQFEVKKYVLPNFEVKITPGKP    250
               ||||||||||||||||||||||||||||||||||||||||||||||||||
                                                                      201
               DFVIPDISEPGTWKISARFSDGLESNSSTQFEVKKYVLPNFEVKITPGKP    250 . . . 251

YILTVPGHLDEMQLDIQARYIYGKPVQGVAYVRFGLLDEDGKKTFFRGLE    300
```

```
                                                     251
YILTVPGHLDEMQLDIQARYIYGKPVQGVAYVRFGLLDEDGKKTFFRGLE   300 . . . 301

SQTKLVNGQSHISLSKAEFQDALEKLNMGITDLQGLRLYVAAAIIESPGG   350
                                                     301
SQTKLVNGQSHISLSKAEFQDALEKLNMGITDLQGLRLYVAAAIIESPGG   350 . . . 351

EMEEAELTSWYFVSSPFSLDLSKTKRHLVPGAPFLLQALVREMSGSPASG   400
                                                     351
EMEEAELTSWYFVSSPFSLDLSKTKRHLVPGAPFLLQALVREMSGSPASG   400 . . . 401

IPVKVSATVSSPGSVPEVQDIQQNTDGSGQVSIPIIIPQTISELQLSVSA   450
                                                     401
IPVKVSATVSSPGSVPEVQDIQQNTDGSGQVSIPIIIPQTISELQLSVSA   450 . . . 451

GSPHPAIARLTVAAPPSGGPGFLSIERPDSRPPRVGDTLNLNLRAVGSGA   500
                                                     451
GSPHPAIARLTVAAPPSGGPGFLSIERPDSRPPRVGDTLNLNLRAVGSGA   500 . . . 501

TFSHYYYMILSRGQIVFMNREPKRTLTSVSVFVDHHLAPSEYFVAFYYHG   550
                                                     501
TFSHYYYMILSRGQIVFMNREPKRTLTSVSVFVDHHLAPSFYFVAFYYHG   550 . . . 551

DHPVANSLRVDVQAGACEGKLELSVDGAKQYRNGESVKLHLETDSLALVA   600
                                                     551
DHPVANSLRVDVQAGACEGKLELSVDGAKQYRNGESVKLHLETDSLALVA   600 . . . 601

LGALDTALYAAGSKSHKPLNMGKVEEAMNSYDLGCGPGGGDSALQVFQAA   650
                                                     601
LGALDTALYAAGSKSHKPLNMGKVFEAMNSYDLGCGPGGGDSALQVFQAA   650 . . . 651

GLAFSDGDQWTLSRKRLSCPKEKTTRKKRNVNFQKAINEKLGQYASPTAK   700
                                                     651
GLAFSDGDQWTLSRKRLSCPKEKTTRKKRNVNFQKAINEKLGQYASPTAK   700 . . . 701

RCCQDGVTRLPMMRSCEQRAARVQQPDCREPFLSCCQFAESLRKKSRDKG   750
                                                     701
RCCQDGVTRLPMMRSCEQRAARVQQPDCREPFLSCCQFAESLRKKSRDKG   750 . . . 751

QAGLQRALEILQEEDLIDEDDIPVRSFFPENWLWRVETVDRFQILTLWLP   800
                                                     751
QAGLQRALEILQEEDLIDEDDIPVRSFFPENWLWRVETVDRFQILTLWLP   800 . . . 801

DSLTTWEIHGLSLSKTKGLCVATPVQLRVFREFHLHLRLPMSVRRFEQLE   850
                                                     801
DSLTTWEIHGLSLSKTKGLCVATPVQLRVFREFHLHLRLPMSVRRFEQLE   850 . . . 851

LRPVLYNYLDKNLTVSVHVSPVEGLCLAGGGGLAQQVLVPAGSARPVAFS   900
                                                     851
LRPVLYNYLDKNLTVSVHVSPVEGLCLAGGGGLAQQVLVPAGSARPVAFS   900 . . . 901

VVPTAAAAVSLKVVARGSFEFPVGDAVSKVLQIEKEGAIHREELVYELNP   950
                                                     901
VVPTAAAAVSLKVVARGSFEFPVGDAVSKVLQIEKEGAIHREELVYELNP   950 . . . 951

LDHRGRTLEIPGNSDPNMIPDGDFNSYVRVTASDPLDTLGSEGALSPGGV  1000
                                                     951
LDHRGRTLEIPGNSDPNMIPDGDFNSYVRVTASDPLDTLGSEGALSPGGV  1000 . . . 1001

ASLLRLPRGCGEQTMIYLAPTLAASRYLDKTEQWSTLPPETKDHAVDLIQ  1050
                                                    1001
ASLLRLPRGCGEQTMIYLAPTLAASRYLDKTEQWSTLPPETKDHAVDLIQ  1050 . . . 1051

KGYMRIQQFRKADGSYAAWLSRDSSTWLTAFVLKVLSLAQEQVGGSPEKL  1100
                                                    1051
KGYMRIQQFRKADGSYAAWLSRDSSTWLTAFVLKVLSLAQEQVGGSPEKL  1100 . . . 1101

QETSNWLLSQQQADGSFQDPCPVLDRSMQGGLVGNDETVALTAFVTIALH  1150
                                                    1101
QETSNWLLSQQQADGSFQDPCPVLDRSMQGGLVGNDETVALTAFVTIALH  1150 . . . 1151

HGLAVFQDEGAEPLKQRVEASISKASSFLGEKASAGLLGAHAAAITAYAL  1200
                                                    1151
HGLAVFQDEGAEPLKQRVEASISKASSFLGEKASAGLLGAHAAAITAYAL  1200 . . . 1201

TLTKAPADLRGVAHNNLMAMAQETGDNLYWGSVTGSQSNAVSPTPAPRNP  1250
                                                    1201
TLTKAPADLRGVAHNNLMAMAQETGDNLYWGSVTGSQSNAVSPTPAPRNP  1250 . . . 1251

SDPMPQAPALWIETTAYALLHLLLHEGKAEMADQAAAWLTRQGSFQGGFR  1300
```

-continued

```
|||||||||||||||||||||||||||||||||||||||||||         1251
SDPMPQAPALWIETTAYALLHLLLHEGKAEMADQAAAWLTRQGSFQGGFR   1300 . . . 1301
STQ                                                 1303
|||                                                 1301
STQ                                                 1303
```

Sequence name: CO4_HUMAN_V1 (SEQ ID NO:486)
Sequence documentation:
Alignment of: HSCOC4_PEA.sub.--1_P9 (SEQ ID NO:495).times.CO4_HUMAN_V1 (SEQ ID NO:486).

Alignment segment 1/1: TABLE-US-00857 Quality: 14831.00 Escore: 0 Matching length: 1529 Total length: 1529 Matching Percent 100.00 Matching Percent 100.00 Similarity: Identity: Total Percent Similarity: 100.00 Total Percent Identity: 100.00 Gaps: 0

```
Alignment TABLE-US-00858 . . . 1
MRLLWGLTWASSFFTLSLQKPRLLLFSPSVVHLGVPLSVGVQLQDVPRGQ   50
|||||||||||||||||||||||||||||||||||||||||||||||||   1
MRLLWGLIWASSFFTLSLQKPRLLLFSPSVVHLGVPLSVGVQLQDVPRGQ   50 . . . 51

VVKGSVFLRNPSRNNVPCSPKVDFTLSSERDFALLSLQVPLKDAKSCGLH   100
|||||||||||||||||||||||||||||||||||||||||||||||||   51
VVKGSVFLRNPSRNNVPCSPKVDFTLSSERDFALLSLQVPLKDAKSCGLH   100 . . . 101

QLLRGPEVQLVAHSPWLKDSLSRTTNIQGINLLFSSRRGRLFLQTDQPIY   150
|||||||||||||||||||||||||||||||||||||||||||       101
QLLRGPEVQLVAHSPWLKDSLSRTTNIQGINLLFSSRRGHLFLQTDQPIY   150 . . . 151

NPGQRVRYRVFALDQKMRPSTDTITVMVENSHGLRVRKKEVYMPSSIFQD   200
|||||||||||||||||||||||||||||||||||||||||||||||||   151
NPGQRVRYRVFALDQKMRPSTDTITVMVENSHGLRVRKKEVYMPSSIFQD   200 . . . 201

DFVIPDISEPGTWKISARFSDGLESNSSTQFEVKKYVLPNFEVKITPGKP   250
|||||||||||||||||||||||||||||||||||||||||||||||||   201
DFVIPDISEPGTWKISARFSDGLESNSSTQFEVKKYVLPNFEVKITPGKP   250 . . . 251

YILTVPGHLDEMQLDIQARYIYGKPVQGVAYVRFGLLDEDGKKTFFRGLE   300
|||||||||||||||||||||||||||||||||||||||||||||||||   251
YILTVPGHLDEMQLDIQARYIYGKPVQGVAYVRFGLLDEDGKKTFFRGLE   300 . . . 301

SQTKLVNGQSHISLSKAEFQDALEKLNMGITDLQGLRLYVAAAIIESPGG   350
|||||||||||||||||||||||||||||||||||||||||||||||||   301
SQTKLVNGQSHISLSKAEFQDALEKLNMGITDLQGLRLYVAAAIIESPGG   350 . . . 351

EMEEAELTSWYFVSSPFSLDLSKTKRHLVPGAPFLLQALVREMSGSPASG   400
|||||||||||||||||||||||||||||||||||||||||||||||||   351
EMEEAELTSWYFVSSPFSLDLSKTKRHLVPGAPFLLQALVREMSGSPASG   400 . . . 401

IPVKVSATVSSPGSVPEVQDIQQNTDGSGQVSIPIIIPQTISELQLSVSA   450
|||||||||||||||||||||||||||||||||||||||||||||||||   401
IPVKVSATVSSPGSVPEVQDIQQNTDGSGQVSIPIIIPQTISELQLSVSA   450 . . . 451

GSPHPAIARLTVAAPPSGGPGFLSIERPDSRPPRVGDTLNLNLRAVGSGA   500
|||||||||||||||||||||||||||||||||||||||||||||||||   451
GSPHPAIARLTVAAPPSGGPGFLSIERPDSRPPRVGDTLNLNLRAVGSGA   500 . . . 501

TFSHYYYMILSRGQIVFMNREPKRTLTSVSVFVDHHLAPSFYFVAFYYHG   550
|||||||||||||||||||||||||||||||||||||||||||||||||   501
TFSHYYYMILSRGQIVFMNREPKRTLTSVSVFVDHHLAPSFYFVAFYYHG   550 . . . 551

DRPVANSLRVDVQAGACEGKLELSVDGAKQYRNGESVKLHLETDSLALVA   600
 |||||||||||||||||||||||||||||||||||||||||||||||   551
DHPVANSLRVDVQAGACEGKLELSVDGAKQYRNGESVKLHLETDSLALVA   600 . . . 601

LGALDTALYAAGSKSHKPLNMGKVFEAMNSYDLGCGPGGGDSALQVFQAA   650
|||||||||||||||||||||||||||||||||||||||||||||||||   601
LGALDTALYAAGSKSHKPLNMGKVFEAMNSYDLGCGPGGGDSALQVFQAA   650 . . . 651

GLAFSDGDQWTLSRKRLSCPKEKTTRKKRNVNFQKAINEKLGQYASPTAK   700
|||||||||||||||||||||||||||||||||||||||||||||||||   651
GLAFSDGDQWTLSRKRLSCPKEKTTRKKRNVNFQKAINEKLGQYASPTAK   700 . . . 701

RCCQDGVTRLPMMRSCEQRAARVQQPDCREPFLSCCQFAESLRKKSRDKG   750
|||||||||||||||||||||||||||||||||||||||||||||||||   701
RCCQDGVTRLPMMRSCEQRAARVQQPDCREPFLSCCQFAESLRKKSRDKG   750 . . . 751

QAGLQRALEILQEEDLIDEDDIPVRSFFPENWLWRVETVDRFQILTLWLP   800
|||||||||||||||||||||||||||||||||||||||||||||||||   751
QAGLQRALEILQEEDLIDEDDIPVRSFFPENWLWRVETVDRFQILTLWLP   800 . . . 801
```

```
DSLTTWEIHGLSLSKTKGLCVATPVQLRVFREFHLHLRLPMSVRRFEQLE    850
|||||||||||||||||||||||||||||||||||||||||||||||||    801
DSLTTWEIHGLSLSKTKGLCVATPVQLRVFREFHLHLRLPMSVRRFEQLE    850 . . . 851

LRPVLYNYLDKNLTVSVHVSPVEGLCLAGGGGLAQQVLVPAGSARPVAFS    900
|||||||||||||||||||||||||||||||||||||||||||||||||    851
LRPVLYNYLDKNLTVSVHVSPVEGLCLAGGGGLAQQVLVPAGSARPVAFS    900 . . . 901

VVPTAAAAVSLKVVARGSFEFPVGDAVSKVLQIEKEGAIHREELVYELNP    950
|||||||||||||||||||||||||||||||||||||||||||||||||    901
VVPTAAAAVSLKVVARGSFEFPVGDAVSKVLQIEKEGAIHREELVYELNP    950 . . . 951

LDHRGRTLEIPGNSDPNMIPDGDFNSYVRVTASDPLDTLGSEGALSPGGV   1000
|||||||||||||||||||||||||||||||||||||||||||||||||    951
LDHRGRTLEIPGNSDPNMIPDGDFNSYVRVTASDPLDTLGSEGALSPGGV   1000 . . . 1001

ASLLRLPRGCGEQTMIYLAPTLAASRYLDKTEQWSTLPPETKDHAVDLIQ   1050
|||||||||||||||||||||||||||||||||||||||||||||||||   1001
ASLLRLPRGCGEQTMIYLAPTLAASRYLDKTEQWSTLPPETKDHAVDLIQ   1050 . . . 1051

KGYMRIQQFRKADGSYAAWLSRDSSTWLTAFVLKVLSLAQEQVGGSPEKL   1100
|||||||||||||||||||||||||||||||||||||||||||||||||   1051
KGYMRIQQFRKADGSYAAWLSRDSSTWLTAFVLKVLSLAQEQVGGSPEKL   1100 . . . 1101

QETSNWLLSQQQADGSFQDPCPVLDRSMQGGLVGNDETVALTAFVTIALH   1150
|||||||||||||||||||||||||||||||||||||||||||||||||   1101
QETSNWLLSQQQADGSFQDPCPVLDRSMQGGLVGNDETVALTAFVTIALH   1150 . . . 1151

HGLAVFQDEGAEPLKQRVEASISKASSFLGEKASAGLLGAHAAAITAYAL   1200
|||||||||||||||||||||||||||||||||||||||||||||||||   1151
HGLAVFQDEGAEPLKQRVEASISKASSFLGEKASAGLLGAHAAAITAYAL   1200 . . . 1201

TLTKAPADLRGVAHNNLMAMAQETGDNLYWGSVTGSQSNAVSPTPAPRNP   1250
|||||||||||||||||||||||||||||||||||||||||||||||||   1201
TLTKAPADLRGVAHNNLMAMAQETGDNLYWGSVTGSQSNAVSPTPAPRNP   1250 . . . 1251

SDPMPQAPALWIETTAYALLHLLLHEGKAEMADQAAAWLTRQGSFQGGFR   1300
|||||||||||||||||||||||||||||||||||||||||||||||||   1251
SDPMPQAPALWIETTAYALLHLLLHEGKAEMADQAAAWLTRQGSFQGGFR   1300 . . . 1301

STQDTVIALDALSAYWIASHTTEERGLNVTLSSTGRNGFKSHALQLNNRQ   1350
|||||||||||||||||||||||||||||||||||||||||||||||||   1301
STQDTVIALDALSAYWIASHTTEERGLNVTLSSTGRNGFKSHALQLNNRQ   1350 . . . 1351

IRGLEEELQFSLGSKINVKVGGNSKGTLKVLRTYNVLDMKNTTCQDLQIE   1400
|||||||||||||||||||||||||||||||||||||||||||||||||   1351
IRGLEEELQFSLGSKINVKVGGNSKGTLKVLRTYNVLDMKNTTCQDLQIE   1400 . . . 1401

VTVKGHVEYTMEANEDYEDYEYDELPAKDDPDAPLQPVTPLQLFEGRRNR   1450
|||||||||||||||||||||||||||||||||||||||||||||||||   1401
VTVKGHVEYTMEANEDYEDYEYDELPAKDDPDAPLQPVTPLQLFEGRRNR   1450 . . . 1451

RRREAPKVVEEQESRVHYTVCIWRNGKVGLSGMAIADVTLLSGFHALRAD   1500
|||||||||||||||||||||||||||||||||||||||||||||||||   1451
RRREAPKVVEEQESRVHYTVCIWRNGKVGLSGMAIADVTLLSGFHALRAD   1500 . . . 1501

LEKLTSLSDRYVSHFETEGPHVLLYFDSV                       1529
|||||||||||||||||||||||||||||                       1501
LEKLTSLSDRYVSHFETEGPHVLLYFDSV                       1529
```

Sequence name: CO4_HUMAN_V1 (SEQ ID NO:486)

Sequence documentation:

Alignment of: HSCOC4_PEA.sub.--1_P22 (SEQ ID NO:496).times.CO4_HUMAN_V1 (SEQ ID NO:486).

Alignment segment 1/1: TABLE-US-00859 Quality: 16066.00 Escore: 0 Matching length: 1654 Total length: 1654 Matching Percent 100.00 Matching Percent 99.94 Similarity: Identity: Total Percent Similarity: 100.00 Total Percent Identity: 99.94 Gaps: 0

```
Alignment TABLE-US-00860 . . . 1
MRLLWGLTWASSFFTLSLQKPRLLLFSPSVVHLGVPLSVGVQLQDVPRGQ    50
||||||||| |||||||||||||||||||||||||||||||||||||||     1
MRLLWGLIWASSFFTLSLQKPRLLLFSPSVVHLGVPLSVGVQLQDVPRGQ    50 . . . 51

VVKGSVFLRNPSRNNVPCSPKVDFTLSSERDFALLSLQVPLKDAKSCGLH   100
|||||||||||||||||||||||||||||||||||||||||||||||||    51
VVKGSVFLRNPSRNNVPCSPKVDFTLSSERDFALLSLQVPLKDAKSCGLH   100 . . . 101
```

-continued

```
QLLRGPEVQLVAHSPWLKDSLSRTTNIQGINLLFSSRRGRLFLQTDQPIY    150
||||||||||||||||||||||||||||||||||||||| |||||||||||  101
QLLRGPEVQLVAHSPWLKDSLSRTTNIQGINLLFSSRRGHLFLQTDQPIY    150 ... 151

NPGQRVRYRVFALDQKMRPSTDTITVMVENSHGLRVRKKEVYMPSSIFQD    200
||||||||||||||||||||||||||||||||||||||||||||||||||   151
NPGQRVRYRVFALDQKMRPSTDTITVMVENSHGLRVRKKEVYMPSSIFQD    200 ... 201

DFVIPDISEPGTWKISARFSDGLESNSSTQFEVKKYVLPNFEVKITPGKP    250
||||||||||||||||||||||||||||||||||||||||||||||||||   201
DFVIPDISEPGTWKISARFSDGLESNSSTQFEVKKYVLPNFEVKITPGKP    250 ... 251

YILTVPGHLDEMQLDIQARYIYGKPVQGVAYVRFGLLDEDGKKTFFRGLE    300
||||||||||||||||||||||||||||||||||||||||||||||||||   251
YILTVPGHLDEMQLDIQARYIYGKPVQGVAYVRFGLLDEDGKKTFFRGLE    300 ... 301

SQTKLVNGQSHISLSKAEFQDALEKLNMGITDLQGLRLYVAAAIIESPGG    350
||||||||||||||||||||||||||||||||||||||||||||||||||   301
SQTKLVNGQSHISLSKAEFQDALEKLNMGITDLQGLRLYVAAAIIESPGG    350 ... 351

EMEEAELTSWYFVSSPFSLDLSKTKRHLVPGAPFLLQALVREMSGSPASG    400
||||||||||||||||||||||||||||||||||||||||||||||||||   351
EMEEAELTSWYFVSSPFSLDLSKTKRHLVPGAPFLLQALVREMSGSPASG    400 ... 401

IPVKVSATVSSPGSVPEVQDIQQNTDGSGQVSIPIIIPQTISELQLSVSA    450
||||||||||||||||||||||||||||||||||||||||||||||||||   401
IPVKVSATVSSPGSVPEVQDIQQNTDGSGQVSIPIIIPQTISELQLSVSA    450 ... 451

GSPHPAIARLTVAAPPSGGPGFLSIERPDSRPPRVGDTLNLNLRAVGSGA    500
||||||||||||||||||||||||||||||||||||||||||||||||||   451
GSPHPAIARLTVAAPPSGGPGFLSIERPDSRPPRVGDTLNLNLRAVGSGA    500 ... 501

TFSHYYYMILSRGQIVFMNREPKRTLTSVSVFVDHHLAPSFYFVAFYYHG    550
||||||||||||||||||||||||||||||||||||||||||||||||||   501
TFSHYYYMILSRGQIVFMNREPKRTLTSVSVFVDHHLAPSFYFVAFYYHG    550 ... 551

DRPVANSLRVDVQAGACEGKLELSVDGAKQYRNGESVKLHLETDSLALVA    600
| |||||||||||||||||||||||||||||||||||||||||||||||   551
DHPVANSLRVDVQAGACEGKLELSVDGAKQYRNGESVKLHLETDSLALVA    600 ... 601

LGALDTALYAAGSKSHKPLNMGKVFEAMNSYDLGCGPGGGDSALQVFQAA    650
||||||||||||||||||||||||||||||||||||||||||||||||||   601
LGALDTALYAAGSKSHKPLNMGKVFEAMNSYDLGCGPGGGDSALQVFQAA    650 ... 651

GLAFSDGDQWTLSRKRLSCPKEKTTRKKRNVNFQKAINEKLGQYASPTAK    700
||||||||||||||||||||||||||||||||||||||||||||||||||   651
GLAFSDGDQWTLSRKRLSCPKEKTTRKKRNVNFQKAINEKLGQYASPTAK    700 ... 701

RCCQDGVTRLPMMRSCEQRAARVQQPDCREPFLSCCQFAESLRKKSRDKG    750
||||||||||||||||||||||||||||||||||||||||||||||||||   701
RCCQDGVTRLPMMRSCEQRAARVQQPDCREPFLSCCQFAESLRKKSRDKG    750 ... 751

QAGLQRALEILQEEDLIDEDDIPVRSFFPENWLWRVETVDRFQILTLWLP    800
||||||||||||||||||||||||||||||||||||||||||||||||||   751
QAGLQRALEILQEEDLIDEDDIPVRSFFPENWLWRVETVDRFQILTLWLP    800 ... 801

DSLTTWEIHGLSLSKTKGLCVATPVQLRVFREFHLHLRLPMSVRRFEQLE    850
||||||||||||||||||||||||||||||||||||||||||||||||||   801
DSLTTWEIHGLSLSKTKGLCVATPVQLRVFREFHLHLRLPMSVRRFEQLE    850 ... 851

LRPVLYNYLDKNLTVSVHVSPVEGLCLAGGGGLAQQVLVPAGSARPVAFS    900
||||||||||||||||||||||||||||||||||||||||||||||||||   851
LRPVLYNYLDKNLTVSVHVSPVEGLCLAGGGGLAQQVLVPAGSARPVAFS    900 ... 901

VVPTAAAAVSLKVVARGSFEFPVGDAVSKVLQIEKEGAIHREELVYELNP    950
||||||||||||||||||||||||||||||||||||||||||||||||||   901
VVPTAAAAVSLKVVARGSFEFPVGDAVSKVLQIEKEGAIHREELVYELNP    950 ... 951

LDHRGRTLEIPGNSDPNMIPDGDFNSYVRVTASDPLDTLGSEGALSPGGV   1000
||||||||||||||||||||||||||||||||||||||||||||||||||   951
LDHRGRTLEIPGNSDPNMIPDGDFNSYVRVTASDPLDTLGSEGALSPGGV   1000 ... 1001

ASLLRLPRGCGEQTMIYLAPTLAASRYLDKTEQWSTLPPETKDHAVDLIQ   1050
||||||||||||||||||||||||||||||||||||||||||||||||||  1001
ASLLRLPRGCGEQTMIYLAPTLAASRYLDKTEQWSTLPPETKDHAVDLIQ   1050 ... 1051

KGYMRIQQFRKADGSYAAWLSRDSSTWLTAFVLKVLSLAQEQVGGSPEKL   1100
||||||||||||||||||||||||||||||||||||||||||||||||||  1051
KGYMRIQQFRKADGSYAAWLSRDSSTWLTAFVLKVLSLAQEQVGGSPEKL   1100 ... 1101
```

-continued

```
QETSNWLLSQQQADGSFQDPCPVLDRSMQGGLVGNDETVALTAFVTIALH   1150
|||||||||||||||||||||||||||||||||||||||||||||||||| 1101
QETSNWLLSQQQADGSFQDPCPVLDRSMQGGLVGNDETVALTAFVTIALH   1150 ... 1151

HGLAVFQDEGAEPLKQRVEASISKASSFLGEKASAGLLGAHAAAITAYAL   1200
|||||||||||||||||||||||||||||||||||||||||||||||||| 1151
HGLAVFQDEGAEPLKQRVEASISKASSFLGEKASAGLLGAHAAAITAYAL   1200 ... 1201

TLTKAPADLRGVAHNNLMAMAQETGDNLYWGSVTGSQSNAVSPTPAPRNP   1250
|||||||||||||||||||||||||||||||||||||||||||||||||| 1201
TLTKAPADLRGVAHNNLMAMAQETGDNLYWGSVTGSQSNAVSPTPAPRNP   1250 ... 1251

SDPMPQAPALWIETTAYALLHLLLHEGKAEMADQAAAWLTRQGSFQGGFR   1300
|||||||||||||||||||||||||||||||||||||||||||||||||| 1251
SDPMPQAPALWIETTAYALLHLLLHEGKAEMADQAAAWLTRQGSFQGGFR   1300 ... 1301

STQDTVIALDALSAYWIASHTTEERGLNVTLSSTGRNGFKSHALQLNNRQ   1350
|||||||||||||||||||||||||||||||||||||||||||||||||| 1301
STQDTVIALDALSAYWIASHTTEERGLNVTLSSTGRNGFKSHALQLNNRQ   1350 ... 1351

IRGLEEELQFSLGSKINVKVGGNSKGTLKVLRTYNVLDMKNTTCQDLQIE   1400
|||||||||||||||||||||||||||||||||||||||||||||||||| 1351
IRGLEEELQFSLGSKINVKVGGNSKGTLKVLRTYNVLDMKNTTCQDLQIE   1400 ... 1401

VTVKGHVEYTMEANEDYEDYEYDELPAKDDPDAPLQPVTPLQLFEGRRNR   1450
|||||||||||||||||||||||||||||||||||||||||||||||||| 1401
VTVKGHVEYTMEANEDYEDYEYDELPAKDDPDAPLQPVTPLQLFEGRRNR   1450 ... 1451

RRREAPKVVEEQESRVHYTVCIWRNGKVGLSGMAIADVTLLSGFHALRAD   1500
|||||||||||||||||||||||||||||||||||||||||||||||||| 1451
RRREAPKVVEEQESRVHYTVCIWRNGKVGLSGMAIADVTLLSGFHALRAD   1500 ... 1501

LEKLTSLSDRYVSHFETEGPHVLLYFDSVPTSRECVGFEAVQEVPVGLVQ   1550
|||||||||||||||||||||||||||||||||||||||||||||||||| 1501
LEKLTSLSDRYVSHFETEGPHVLLYFDSVPTSRECVGFEAVQEVPVGLVQ   1550 ... 1551
PASATLYDYYNPERRCSVFYGAPSKSRLLATLCSAEVCQCAEGKCPRQRR   1600
|||||||||||||||||||||||||||||||||||||||||||||||||| 1551
PASATLYDYYNPERRCSVFYGAPSKSRLLATLCSAEVCQCAEGKCPRQRR   1600 ... 1601

ALERGLQDEDGYRMKFACYYPRVEYGFQVKVLREDSRAAFRLFETKITQV   1650
|||||||||||||||||||||||||||||||||||||||||||||||||| 1601
ALERGLQDEDGYRMKFACYYPRVEYGFQVKVLREDSRAAFRLFETKITQV   1650 ... 1651

LHFS                                                 1654
|||:                                                 1651
LHFT                                                 1654
```

40

Sequence name: CO4_HUMAN_V1 (SEQ ID NO:486)

Sequence documentation:

Alignment of: HSCOC4_PEA.sub.--1_P23 (SEQ ID NO:497).times.CO4_HUMAN_V1 (SEQ ID NO:486).

Alignment segment 1/1: TABLE-US-00861 Quality: 15806.00 Escore: 0 Matching length: 1626 Total length: 1626 Matching Percent 100.00 Matching Percent 100.00 Similarity: Identity: Total Percent Similarity: 100.00 Total Percent Identity: 100.00 Gaps: 0

```
Alignment TABLE-US-00862 ... 1
MRLLWGLTWASSFFTLSLQKPRLLLFSPSVVHLGVPLSVGVQLQDVPRGQ   50
|||||||| |||||||||||||||||||||||||||||||||||||||| 1
MRLLWGLIWASSFFTLSLQKPRLLLFSPSVVHLGVPLSVGVQLQDVPRGQ   50 ... 51

VVKGSVFLRNPSRNNVPCSPKVDFTLSSERDFALLSLQVPLKDAKSCGLH   100
|||||||||||||||||||||||||||||||||||||||||||||||||| 51
VVKGSVFLRNPSRNNVPCSPKVDFTLSSERDFALLSLQVPLKDAKSCGLH   100 ... 101

QLLRGPEVQLVAHSPWLKDSLSRTTNIQGINLLFSSRRGRLFLQTDQPIY   150
||||||||||||||||||||||||||||||||||||||| |||||||||| 101
QLLRGPEVQLVAHSPWLKDSLSRTTNIQGINLLFSSRRGHLFLQTDQPIY   150 ... 151

NPGQRVRYRVFALDQKMRPSTDTITVMVENSHGLRVRKKEVYMPSSIFQD   200
|||||||||||||||||||||||||||||||||||||||||||||||||| 151
NPGQRVRYRVFALDQKMRPSTDTITVMVENSHGLRVRKKEVYMPSSIFQD   200 ... 201

DFVIPDISEPGTWKISARFSDGLESNSSTQFEVKKYVLPNFEVKITPGKP   250
|||||||||||||||||||||||||||||||||||||||||||||||||| 201
DFVIPDISEPGTWKISARFSDGLESNSSTQFEVKKYVLPNFEVKITPGKP   250 ... 251

YILTVPGHLDEMQLDIQARYIYGKPVQGVAYVRFGLLDEDGKKTFFRGLE   300
|||||||||||||||||||||||||||||||||||||||||||||||||| 251
```

-continued

```
YILTVPGHLDEMQLDIQARYIYGKPVQGVAYVRFGLLDEDGKKTFFRGLE    300 ... 301

SQTKLVNGQSHISLSKAEFQDALEKLNMGITDLQGLRLYVAAAIIESPGG    350
                                                    301
SQTKLVNGQSHISLSKAEFQDALEKLNMGITDLQGLRLYVAAAIIESPGG    350 ... 351

EMEEAELTSWYFVSSPFSLDLSKTKRHLVPGAPFLLQALVREMSGSPASG    400
                                                    351
EMEEAELTSWYFVSSPFSLDLSKTKRHLVPGAPFLLQALVREMSGSPASG    400 ... 401

IPVKVSATVSSPGSVPEVQDIQQNTDGSGQVSIPIIIPQTISELQLSVSA    450
                                                    401
IPVKVSATVSSPGSVPEVQDIQQNTDGSGQVSIPIIIPQTISELQLSVSA    450 ... 451

GSPHPAIARLTVAAPPSGGPGFLSIERPDSRPPRVGDTLNLNLRAVGSGA    500
                                                    451
GSPHPAIARLTVAAPPSGGPGFLSIERPDSRPPRVGDTLNLNLRAVGSGA    500 ... 501

TFSHYYYMILSRGQIVFMNREPKRTLTSVSVFVDHHLAPSFYFVAFYYHG    550
                                                    501
TFSHYYYMILSRGQIVFMNREPKRTLTSVSVFVDHHLAPSFYFVAFYYHG    550 ... 551

DRPVANSLRVDVQAGACEGKLELSVDGAKQYRNGESVKLHLETDSLALVA    600
                                                    551
DHPVANSLRVDVQAGACEGKLELSVDGAKQYRNGESVKLHLETDSLALVA    600 ... 601

LGALDTALYAAGSKSHKPLNMGKVFEAMNSYDLGCGPGGGDSALQVFQAA    650
                                                    601
LGALDTALYAAGSKSHKPLNMGKVFEAMNSYDLGCGPGGGDSALQVFQAA    650 ... 651

GLAFSDGDQWTLSRKRLSCPKEKTTRKKRNVNFQKAINEKLGQYASPTAK    700
                                                    651
GLAFSDGDQWTLSRKRLSCPKEKTTRKKRNVNFQKAINEKLGQYASPTAK    700 ... 701

RCCQDGVTRLPMMRSCEQRAARVQQPDCREPFLSCCQFAESLRKKSRDKG    750
                                                    701
RCCQDGVTRLPMMRSCEQRAARVQQPDCREPFLSCCQFAESLRKKSRDKG    750 ... 751

QAGLQRALEILQEEDLIDEDDIPVRSFFPENWLWRVETVDRFQILTLWLP    800
                                                    751
QAGLQRALEILQEEDLIDEDDIPVRSFFPENWLWRVETVDRFQILTLWLP    800 ... 801

DSLTTWEIHGLSLSKTKGLCVATPVQLRVFREFHLHLRLPMSVRRFEQLE    850
                                                    801
DSLTTWEIHGLSLSKTKGLCVATPVQLRVFREFHLHLRLPMSVRRFEQLE    850 ... 851

LRPVLYNYLDKNLTVSVHVSPVEGLCLAGGGGLAQQVLVPAGSARPVAFS    900
                                                    851
LRPVLYNYLDKNLTVSVHVSPVEGLCLAGGGGLAQQVLVPAGSARPVAFS    900 ... 901

VVPTAAAAVSLKVVARGSFEFPVGDAVSKVLQIEKEGAIHREELVYELNP    950
                                                    901
VVPTAAAAVSLKVVARGSFEFPVGDAVSKVLQIEKEGAIHREELVYELNP    950 ... 951

LDHRGRTLEIPGNSDPNMIPDGDFNSYVRVTASDPLDTLGSEGALSPGGV    1000
                                                    951
LDHRGRTLEIPGNSDPNMIPDGDFNSYVRVTASDPLDTLGSEGALSPGGV    1000 ... 1001

ASLLRLPRGCGEQTMIYLAPTLAASRYLDKTEQWSTLPPETKDHAVDLIQ    1050
                                                    1001
ASLLRLPRGCGEQTMIYLAPTLAASRYLDKTEQWSTLPPETKDHAVDLIQ    1050 ... 1051

KGYMRIQQFRKADGSYAAWLSRDSSTWLTAFVLKVLSLAQEQVGGSPEKL    1100
                                                    1051
KGYMRIQQFRKADGSYAAWLSRDSSTWLTAFVLKVLSLAQEQVGGSPEKL    1100 ... 1101

QETSNWLLSQQQADGSFQDPCPVLDRSMQGGLVGNDETVALTAFVTIALH    1150
                                                    1101
QETSNWLLSQQQADGSFQDPCPVLDRSMQGGLVGNDETVALTAFVTIALH    1150 ... 1151

HGLAVFQDEGAEPLKQRVEASISKASSFLGEKASAGLLGAHAAAITAYAL    1200
                                                    1151
HGLAVFQDEGAEPLKQRVEASISKASSFLGEKASAGLLGAHAAAITAYAL    1200 ... 1201

TLTKAPADLRGVAHNNLMAMAQETGDNLYWGSVTGSQSNAVSPTPAPRNP    1250
                                                    1201
TLTKAPADLRGVAHNNLMAMAQETGDNLYWGSVTGSQSNAVSPTPAPRNP    1250 ... 1251

SDPMPQAPALWIETTAYALLHLLLHEGKAEMADQAAAWLTRQGSFQGGFR    1300
                                                    1251
```

-continued
```
SDPMPQAPALWIETTAYALLHLLLHEGKAEMADQAAAWLTRQGSFQGGFR  1300 . . . 1301

STQDTVIALDALSAYWIASHTTEERGLNVTLSSTGRNGFKSHALQLNNRQ  1350
||||||||||||||||||||||||||||||||||||||||||||||||||  1301
STQDTVIALDALSAYWIASHTTEERGLNVTLSSTGRNGFKSHALQLNNRQ  1350 . . . 1351

IRGLEEELQFSLGSKINVKVGGNSKGTLKVLRTYNVLDMKNTTCQDLQIE  1400
||||||||||||||||||||||||||||||||||||||||||||||||||  1351
IRGLEEELQFSLGSKINVKVGGNSKGTLKVLRTYNVLDMKNTTCQDLQIE  1400 . . . 1401

VTVKGHVEYTMEANEDYEDYEYDELPAKDDPDAPLQPVTPLQLFEGRRNR  1450
||||||||||||||||||||||||||||||||||||||||||||||||||  1401
VTVKGHVEYTMEANEDYEDYEYDELPAKDDPDAPLQPVTPLQLFEGRRNR  1450 . . . 1451

RRREAPKVVEEQESRVHYTVCIWRNGKVGLSGMAIADVTLLSGFHALRAD  1500
||||||||||||||||||||||||||||||||||||||||||||||||||  1451
RRREAPKVVEEQESRVHYTVCIWRNGKVGLSGMAIADVTLLSGFHALRAD  1500 . . . 1501

LEKLTSLSDRYVSHFETEGPHVLLYFDSVPTSRECVGFEAVQEVPVGLVQ  1550
||||||||||||||||||||||||||||||||||||||||||||||||||  1501
LEKLTSLSDRYVSHFETEGPHVLLYFDSVPTSRECVGFEAVQEVPVGLVQ  1550 . . . 1551

PASATLYDYYNPERRCSVFYGAPSKSRLLATLCSAEVCQCAEGKCPRQRR  1600
||||||||||||||||||||||||||||||||||||||||||||||||||  1551
PASATLYDYYNPERRCSVFYGAPSKSRLLATLCSAEVCQCAEGKCPRQRR  1600 . . . 1601

ALERGLQDEDGYRMKFACYYPRVEYG                          1626
||||||||||||||||||||||||||                          1601
ALERGLQDEDGYRMKFACYYPRVEYG                          1626
```

Sequence name: CO4_HUMAN_V1 (SEQ ID NO:486)

Sequence documentation:

Alignment of: HSCOC4_PEA.sub.--1_P24 (SEQ ID NO:498).times.CO4_HUMAN_V1 (SEQ ID NO:486).

Alignment segment 1/1: TABLE-US-00863 Quality: 14823.00 Escore: 0 Matching length: 1528 Total length: 1528 Matching Percent 100.00 Matching Percent 100.00 Similarity: Identity: Total Percent Similarity: 100.00 Total Percent Identity: 100.00 Gaps: 0

```
Alignment: TABLE-US-00864 . . . 1
MRLLWGLTWASSFFTLSLQKPRLLLFSPSVVHLGVPLSVGVQLQDVPRGQ   50
|||||||| |||||||||||||||||||||||||||||||||||||||||   1
MRLLWGLIWASSFFTLSLQKPRLLLFSPSVVHLGVPLSVGVQLQDVPRGQ   50 . . . 51

VVKGSVFLRNPSRNNVPCSPKVDFTLSSERDFALLSLQVPLKDAKSCGLH  100
||||||||||||||||||||||||||||||||||||||||||||||||||   51
VVKGSVFLRNPSRNNVPCSPKVDFTLSSERDFALLSLQVPLKDAKSCGLH  100 . . . 101

QLLRGPEVQLVAHSPWLKDSLSRTTNIQGINLLFSSRRGRLFLQTDQPIY  150
||||||||||||||||||||||||||||||||||||||| ||||||||||  101
QLLRGPEVQLVAHSPWLKDSLSRTTNIQGINLLFSSRRGHLFLQTDQPIY  150 . . . 151

NPGQRVRYRVFALDQKMRPSTDTITVMVENSHGLRVRKKEVYMPSSIFQD  200
||||||||||||||||||||||||||||||||||||||||||||||||||  151
NPGQRVRYRVFALDQKMRPSTDTITVMVENSHGLRVRKKEVYMPSSIFQD  200 . . . 201

DFVIPDISEPGTWKISARFSDGLESNSSTQFEVKKYVLPNFEVKITPGKP  250
||||||||||||||||||||||||||||||||||||||||||||||||||  201
DFVIPDISEPGTWKISARFSDGLESNSSTQFEVKKYVLPNFEVKITPGKP  250 . . . 251

YILTVPGHLDEMQLDIQARYIYGKPVQGVAYVRFGLLDEDGKKTFFRGLE  300
||||||||||||||||||||||||||||||||||||||||||||||||||  251
YILTVPGHLDEMQLDIQARYIYGKPVQGVAYVRFGLLDEDGKKTFFRGLE  300 . . . 301

SQTKLVNGQSHISLSKAEFQDALEKLNMGITDLQGLRLYVAAAIIESPGG  350
||||||||||||||||||||||||||||||||||||||||||||||||||  301
SQTKLVNGQSHISLSKAEFQDALEKLNMGITDLQGLRLYVAAAIIESPGG  350 . . . 351

EMEEAELTSWYFVSSPFSLDLSKTKRHLVPGAPFLLQALVREMSGSPASG  400
||||||||||||||||||||||||||||||||||||||||||||||||||  351
EMEEAELTSWYFVSSPFSLDLSKTKRHLVPGAPFLLQALVREMSGSPASG  400 . . . 401

IPVKVSATVSSPGSVPEVQDIQQNTDGSGQVSIPIIIPQTISELQLSVSA  450
||||||||||||||||||||||||||||||||||||||||||||||||||  401
IPVKVSATVSSPGSVPEVQDIQQNTDGSGQVSIPIIIPQTISELQLSVSA  450 . . . 451

GSPHPAIARLTVAAPPSGGPGFLSIERPDSRPPRVGDTLNLNLRAVGSGA  500
||||||||||||||||||||||||||||||||||||||||||||||||||  451
GSPHPAIARLTVAAPPSGGPGFLSIERPDSRPPRVGDTLNLNLRAVGSGA  500 . . . 501
```

```
TFSHYYYMILSRGQIVFMNREPKRTLTSVSVFVDHHLAPSFYFVAFYYHG   550
|||||||||||||||||||||||||||||||||||||||||||||||||| 501
TFSHYYYMILSRGQIVFMNREPKRTLTSVSVFVDHHLAPSFYFVAFYYHG   550 ... 551

DRPVANSLRVDVQAGACEGKLELSVDGAKQYRNGESVKLHLETDSLALVA   600
 ||||||||||||||||||||||||||||||||||||||||||||||||| 551
DHPVANSLRVDVQAGACEGKLELSVDGAKQYRNGESVKLHLETDSLALVA   600 ... 601

LGALDTALYAAGSKSHKPLNMGKVFEAMNSYDLGCGPGGGDSALQVFQAA   650
|||||||||||||||||||||||||||||||||||||||||||||||||| 601
LGALDTALYAAGSKSHKPLNMGKVFEAMNSYDLGCGPGGGDSALQVFQAA   650 ... 651

GLAFSDGDQWTLSRKRLSCPKEKTTRKKRNVNFQKAINEKLGQYASPTAK   700
|||||||||||||||||||||||||||||||||||||||||||||||||| 651
GLAFSDGDQWTLSRKRLSCPKEKTTRKKRNVNFQKAINEKLGQYASPTAK   700 ... 701

RCCQDGVTRLPMMRSCEQRAARVQQPDCREPFLSCCQFAESLRKKSRDKG   750
|||||||||||||||||||||||||||||||||||||||||||||||||| 701
RCCQDGVTRLPMMRSCEQRAARVQQPDCREPFLSCCQFAESLRKKSRDKG   750 ... 751

QAGLQRALEILQEEDLIDEDDIPVRSFFPENWLWRVETVDRFQILTLWLP   800
|||||||||||||||||||||||||||||||||||||||||||||||||| 751
QAGLQRALEILQEEDLIDEDDIPVRSFFPENWLWRVETVDRFQILTLWLP   800 ... 801

DSLTTWEIHGLSLSKTKGLCVATPVQLRVFREFHLHLRLPMSVRRFEQLE   850
|||||||||||||||||||||||||||||||||||||||||||||||||| 801
DSLTTWEIHGLSLSKTKGLCVATPVQLRVFREFHLHLRLPMSVRRFEQLE   850 ... 851

LRPVLYNYLDKNLTVSVHVSPVEGLCLAGGGGLAQQVLVPAGSARPVAFS   900
|||||||||||||||||||||||||||||||||||||||||||||||||| 851
LRPVLYNYLDKNLTVSVHVSPVEGLCLAGGGGLAQQVLVPAGSARPVAFS   900 ... 901

VVPTAAAAVSLKVVARGSFEFPVGDAVSKVLQIEKEGAIHREELVYELNP   950
|||||||||||||||||||||||||||||||||||||||||||||||||| 901
VVPTAAAAVSLKVVARGSFEFPVGDAVSKVLQIEKEGAIHREELVYELNP   950 ... 951

LDHRGRTLEIPGNSDPNMIPDGDFNSYVRVTASDPLDTLGSEGALSPGGV  1000
|||||||||||||||||||||||||||||||||||||||||||||||||| 951
LDHRGRTLEIPGNSDPNMIPDGDFNSYVRVTASDPLDTLGSEGALSPGGV  1000 ... 1001

ASLLRLPRGCGEQTMIYLAPTLAASRYLDKTEQWSTLPPETKDHAVDLIQ  1050
|||||||||||||||||||||||||||||||||||||||||||||||||| 1001
ASLLRLPRGCGEQTMIYLAPTLAASRYLDKTEQWSTLPPETKDHAVDLIQ  1050 ... 1051

KGYMRIQQFRKADGSYAAWLSRDSSTWLTAFVLKVLSLAQEQVGGSPEKL  1100
|||||||||||||||||||||||||||||||||||||||||||||||||| 1051
KGYMRIQQFRKADGSYAAWLSRDSSTWLTAFVLKVLSLAQEQVGGSPEKL  1100 ... 1101

QETSNWLLSQQQADGSFQDPCPVLDRSMQGGLVGNDETVALTAFVTIALH  1150
|||||||||||||||||||||||||||||||||||||||||||||||||| 1101
QETSNWLLSQQQADGSFQDPCPVLDRSMQGGLVGNDETVALTAFVTIALH  1150 ... 1151

HGLAVFQDEGAEPLKQRVEASISKASSFLGEKASAGLLGAHAAAITAYAL  1200
|||||||||||||||||||||||||||||||||||||||||||||||||| 1151
HGLAVFQDEGAEPLKQRVEASISKASSFLGEKASAGLLGAHAAAITAYAL  1200 ... 1201

TLTKAPADLRGVAHNNLMAMAQETGDNLYWGSVTGSQSNAVSPTPAPRNP  1250
|||||||||||||||||||||||||||||||||||||||||||||||||| 1201
TLTKAPADLRGVAHNNLMAMAQETGDNLYWGSVTGSQSNAVSPTPAPRNP  1250 ... 1251

SDPMPQAPALWIETTAYALLHLLLHEGKAEMADQAAAWLTRQGSFQGGFR  1300
|||||||||||||||||||||||||||||||||||||||||||||||||| 1251
SDPMPQAPALWIETTAYALLHLLLHEGKAEMADQAAAWLTRQGSFQGGFR  1300 ... 1301

STQDTVIALDALSAYWIASHTTEERGLNVTLSSTGRNGFKSHALQLNNRQ  1350
|||||||||||||||||||||||||||||||||||||||||||||||||| 1301
STQDTVIALDALSAYWIASHTTEERGLNVTLSSTGRNGFKSHALQLNNRQ  1350 ... 1351

IRGLEEELQFSLGSKINVKVGGNSKGTLKVLRTYNVLDMKNTTCQDLQIE  1400
|||||||||||||||||||||||||||||||||||||||||||||||||| 1351
IRGLEEELQFSLGSKINVKVGGNSKGTLKVLRTYNVLDMKNTTCQDLQIE  1400 ... 1401

VTVKGHVEYTMEANEDYEDYEDELPAKDDPDAPLQPVTPLQLFEGRRNR   1450
|||||||||||||||||||||||||||||||||||||||||||||||||| 1401
VTVKGHVEYTMEANEDYEDYEDELPAKDDPDAPLQPVTPLQLFEGRRNR   1450 ... 1451

RRREAPKVVEEQESRVHYTVCIWRNGKVGLSGMAIADVTLLSGFHALRAD  1500
|||||||||||||||||||||||||||||||||||||||||||||||||| 1451
RRREAPKVVEEQESRVHYTVCIWRNGKVGLSGMAIADVTLLSGFHALRAD  1500 ... 1501
```

-continued

```
LEKLTSLSDRYVSHFETEGPHVLLYFDS                    1528
||||||||||||||||||||||||||||                    1501
LEKLTSLSDRYVSHFETEGPHVLLYFDS                    1528
```

Sequence name: CO4_HUMAN_V1 (SEQ ID NO:486)
Sequence documentation:
Alignment of: HSCOC4_PEA.sub.--1_P25 (SEQ ID NO:499).times.CO4_HUMAN_V1 (SEQ ID NO:486).

Alignment segment 1/1: TABLE-US-00865 Quality: 15464.00 Escore: 0 Matching length: 1593 Total length: 1593 Matching Percent 100.00 Matching Percent 100.00 Similarity: Identity: Total Percent Similarity: 100.00 Total Percent Identity: 100.00 Gaps: 0

```
Alignment: TABLE-US-00866 . . . 1
MRLLWGLTWASSFFTLSLQKPRLLLFSPSVVHLGVPLSVGVQLQDVPRGQ    50
|||||||| |||||||||||||||||||||||||||||||||||||||||    1
MRLLWGLIWASSFFTLSLQKPRLLLFSPSVVHLGVPLSVGVQLQDVPRGQ    50 . . . 51

VVKGSVFLRNPSRNNVPCSPKVDFTLSSERDFALLSLQVPLKDAKSCGLH    100
|||||||||||||||||||||||||||||||||||||||||||||||||    51
VVKGSVFLRNPSRNNVPCSPKVDFTLSSERDFALLSLQVPLKDAKSCGLH    100 . . . 101

QLLRGPEVQLVAHSPWLKDSLSRTTNIQGINLLFSSRRGRLFLQTDQPIY    150
|||||||||||||||||||||||||||||||||||||| |||||||||||   101
QLLRGPEVQLVAHSPWLKDSLSRTTNIQGINLLFSSRRGHLFLQTDQPIY    150 . . . 151

NPGQRVRYRVFALDQKMRPSTDTITVMVENSHGLRVRKKEVYMPSSIFQD    200
|||||||||||||||||||||||||||||||||||||||||||||||||    151
NPGQRVRYRVFALDQKMRPSTDTITVMVENSHGLRVRKKEVYMPSSIFQD    200 . . . 201

DFVIPDISEPGTWKISARFSDGLESNSSTQFEVKKYVLPNFEVKITPGKP    250
|||||||||||||||||||||||||||||||||||||||||||||||||    201
DFVIPDISEPGTWKISARFSDGLESNSSTQFEVKKYVLPNFEVKITPGKP    250 . . . 251

YILTVPGHLDEMQLDIQARYIYGKPVQGVAYVRFGLLDEDGKKTFFRGLE    300
|||||||||||||||||||||||||||||||||||||||||||||||||    251
YILTVPGHLDEMQLDIQARYIYGKPVQGVAYVRFGLLDEDGKKTFFRGLE    300 . . . 301

SQTKLVNGQSHISLSKAEFQDALEKLNMGITDLQGLRLYVAAAIIESPGG    350
|||||||||||||||||||||||||||||||||||||||||||||||||    301
SQTKLVNGQSHISLSKAEFQDALEKLNMGITDLQGLRLYVAAAIIESPGG    350 . . . 351

EMEEAELTSWYFVSSPFSLDLSKTKRHLVPGAPFLLQALVREMSGSPASG    400
|||||||||||||||||||||||||||||||||||||||||||||||||    351
EMEEAELTSWYFVSSPFSLDLSKTKRHLVPGAPFLLQALVREMSGSPASG    400 . . . 401

IPVKVSATVSSPGSVPEVQDIQQNTDGSGQVSIPIIIPQTISELQLSVSA    450
|||||||||||||||||||||||||||||||||||||||||||||||||    401
IPVKVSATVSSPGSVPEVQDIQQNTDGSGQVSIPIIIPQTISELQLSVSA    450 . . . 451

GSPHPAIARLTVAAPPSGGPGFLSIERPDSRPPRVGDTLNLNLRAVGSGA    500
|||||||||||||||||||||||||||||||||||||||||||||||||    451
GSPHPAIARLTVAAPPSGGPGFLSIERPDSRPPRVGDTLNLNLRAVGSGA    500 . . . 501

TFSHYYYMILSRGQIVFMNREPKRTLTSVSVFVDHHLAPSFYFVAFYYHG    550
|||||||||||||||||||||||||||||||||||||||||||||||||    501
TFSHYYYMILSRGQIVFMNREPKRTLTSVSVFVDHHLAPSFYFVAFYYHG    550 . . . 551

DRPVANSLRVDVQAGACEGKLELSVDGAKQYRNGESVKLHLETDSLALVA    600
 |||||||||||||||||||||||||||||||||||||||||||||||||   551
DHPVANSLRVDVQAGACEGKLELSVDGAKQYRNGESVKLHLETDSLALVA    600 . . . 601

LGALDTALYAAGSKSHKPLNMGKVFEAMNSYDLGCGPGGGDSALQVFQAA    650
|||||||||||||||||||||||||||||||||||||||||||||||||    601
LGALDTALYAAGSKSHKPLNMGKVFEAMNSYDLGCGPGGGDSALQVFQAA    650 . . . 651

GLAFSDGDQWTLSRKRLSCPKEKTTRKKRNVNFQKAINEKLGQYASPTAK    700
|||||||||||||||||||||||||||||||||||||||||||||||||    651
GLAFSDGDQWTLSRKRLSCPKEKTTRKKRNVNFQKAINEKLGQYASPTAK    700 . . . 701

RCCQDGVTRLPMMRSCEQRAARVQQPDCREPFLSCCQFAESLRKKSRDKG    750
|||||||||||||||||||||||||||||||||||||||||||||||||    701
RCCQDGVTRLPMMRSCEQRAARVQQPDCREPFLSCCQFAESLRKKSRDKG    750 . . . 751

QAGLQRALEILQEEDLIDEDDIPVRSFFPENWLWRVETVDRFQILTLWLP    800
|||||||||||||||||||||||||||||||||||||||||||||||||    751
QAGLQRALEILQEEDLIDEDDIPVRSFFPENWLWRVETVDRFQILTLWLP    800 . . . 801
```

```
                                -continued
DSLTTWEIHGLSLSKTKGLCVATPVQLRVFREFHLHLRLPMSVRRFEQLE  850
||||||||||||||||||||||||||||||||||||||||||||||||||  801
DSLTTWEIHGLSLSKTKGLCVATPVQLRVFREFHLHLRLPMSVRRFEQLE  850 . . . 851

LRPVLYNYLDKNLTVSVHVSPVEGLCLAGGGGLAQQVLVPAGSARPVAFS  900
||||||||||||||||||||||||||||||||||||||||||||||||||  851
LRPVLYNYLDKNLTVSVHVSPVEGLCLAGGGGLAQQVLVPAGSARPVAFS  900 . . . 901

VVPTAAAAVSLKVVARGSFEFPVGDAVSKVLQIEKEGAIHREELVYELNP  950
||||||||||||||||||||||||||||||||||||||||||||||||||  901
VVPTAAAAVSLKVVARGSFEFPVGDAVSKVLQIEKEGAIHREELVYELNP  950 . . . 951

LDHRGRTLEIPGNSDPNMIPDGDFNSYVRVTASDPLDTLGSEGALSPGGV  1000
||||||||||||||||||||||||||||||||||||||||||||||||||  951
LDHRGRTLEIPGNSDPNMIPDGDFNSYVRVTASDPLDTLGSEGALSPGGV  1000 . . . 1001

ASLLRLPRGCGEQTMIYLAPTLAASRYLDKTEQWSTLPPETKDHAVDLIQ  1050
||||||||||||||||||||||||||||||||||||||||||||||||||  1001
ASLLRLPRGCGEQTMIYLAPTLAASRYLDKTEQWSTLPPETKDHAVDLIQ  1050 . . . 1051

KGYMRIQQFRKADGSYAAWLSRDSSTWLTAFVLKVLSLAQEQVGGSPEKL  1100
||||||||||||||||||||||||||||||||||||||||||||||||||  1051
KGYMRIQQFRKADGSYAAWLSRDSSTWLTAFVLKVLSLAQEQVGGSPEKL  1100 . . . 1101

QETSNWLLSQQQADGSFQDPCPVLDRSMQGGLVGNDETVALTAFVTIALH  1150
||||||||||||||||||||||||||||||||||||||||||||||||||  1101
QETSNWLLSQQQADGSFQDPCPVLDRSMQGGLVGNDETVALTAFVTIALH  1150 . . . 1151

HGLAVFQDEGAEPLKQRVEASISKASSFLGEKASAGLLGAHAAAITAYAL  1200
||||||||||||||||||||||||||||||||||||||||||||||||||  1151
HGLAVFQDEGAEPLKQRVEASISKASSFLGEKASAGLLGAHAAAITAYAL  1200 . . . 1201

TLTKAPADLRGVAHNNLMAMAQETGDNLYWGSVTGSQSNAVSPTPAPRNP  1250
||||||||||||||||||||||||||||||||||||||||||||||||||  1201
TLTKAPADLRGVAHNNLMAMAQETGDNLYWGSVTGSQSNAVSPTPAPRNP  1250 . . . 1251

SDPMPQAPALWIETTAYALLHLLLHEGKAEMADQAAAWLTRQGSFQGGFR  1300
||||||||||||||||||||||||||||||||||||||||||||||||||  1251
SDPMPQAPALWIETTAYALLHLLLHEGKAEMADQAAAWLTRQGSFQGGFR  1300 . . . 1301

STQDTVIALDALSAYWIASHTTEERGLNVTLSSTGRNGFKSHALQLNNRQ  1350
||||||||||||||||||||||||||||||||||||||||||||||||||  1301
STQDTVIALDALSAYWIASHTTEERGLNVTLSSTGRNGFKSHALQLNNRQ  1350 . . . 1351

IRGLEEELQFSLGSKINVKVGGNSKGTLKVLRTYNVLDMKNTTCQDLQIE  1400
||||||||||||||||||||||||||||||||||||||||||||||||||  1351
IRGLEEELQFSLGSKINVKVGGNSKGTLKVLRTYNVLDMKNTTCQDLQIE  1400 . . . 1401

VTVKGHVEYTMEANEDYEDYEYDELPAKDDPDAPLQPVTPLQLFEGRRNR  1450
||||||||||||||||||||||||||||||||||||||||||||||||||  1401
VTVKGHVEYTMEANEDYEDYEYDELPAKDDPDAPLQPVTPLQLFEGRRNR  1450 . . . 1451

RRREAPKVVEEQESRVHYTVCIWRNGKVGLSGMAIADVTLLSGFHALRAD  1500
||||||||||||||||||||||||||||||||||||||||||||||||||  1451
RRREAPKVVEEQESRVHYTVCIWRNGKVGLSGMAIADVTLLSGFHALRAD  1500 . . . 1501

LEKLTSLSDRYVSHFETEGPHVLLYFDSVPTSRECVGFEAVQEVPVGLVQ  1550
||||||||||||||||||||||||||||||||||||||||||||||||||  1501
LEKLTSLSDRYVSHFETEGPHVLLYFDSVPTSRECVGFEAVQEVPVGLVQ  1550 . . . 1551

PASATLYDYYNPERRCSVFYGAPSKSRLLATLCSAEVCQCAEG  1593
||||||||||||||||||||||||||||||||||||||||||  1551
PASATLYDYYNPERRCSVFYGAPSKSRLLATLCSAEVCQCAEG  1593
```

Sequence name: CO4_HUMAN_V1 (SEQ ID NO:486)
Sequence documentation:
Alignment of: HSCOC4_PEA.sub.--1_P26 (SEQ ID NO:500).times.CO4_HUMAN_V1 (SEQ ID NO:486).

Alignment segment 1/1: TABLE-US-00867 Quality: 15464.00 Escore: 0 Matching length: 1593 Total length: 1593 Matching Percent 100.00 Matching Percent 100.00 Similarity: Identity: Total. Percent Similarity: 100.00 Total Percent Identity: 100.00 Gaps: 0

```
Alignment: TABLE-US-00868 . . . 1
MRLLWGLTWASSFFTLSLQKPRLLLFSPSVVHLGVPLSVGVQLQDVPRGQ  50
|||||||| ||||||||||||||||||||||||||||||||||||||||   1
MRLLWGLIWASSFFTLSLQKPRLLLFSPSVVHLGVPLSVGVQLQDVPRGQ  50 . . . 51

VVKGSVFLRNPSRNNVPCSPKVDFTLSSERDFALLSLQVPLKDAKSCGLH  100
```

```
                                                              51
VVKGSVFLRNPSRNNVPCSPKVDFTLSSERDFALLSLQVPLKDAKSCGLH            100  ...  101

QLLRGPEVQLVAHSPWLKDSLSRTTNIQGINLLFSSRRGRLFLQTDQPIY            150
                                                              101
QLLRGPEVQLVAHSPWLKDSLSRTTNIQGINLLFSSRRGHLFLQTDQPIY            150  ...  151

NPGQRVRYRVFALDQKMRPSTDTITVMVENSHGLRVRKKEVYMPSSIFQD            200
                                                              151
NPGQRVRYRVFALDQKMRPSTDTITVMVENSHGLRVRKKEVYMPSSIFQD            200  ...  201

DFVIPDISEPGTWKISARFSDGLESNSSTQFEVKKYVLPNFEVKITPGKP            250
                                                              201
DFVIPDISEPGTWKISARFSDGLESNSSTQFEVKKYVLPNFEVKITPGKP            250  ...  251

YILTVPGHLDEMQLDIQARYIYGKPVQGVAYVRFGLLDEDGKKTFFRGLE            300
                                                              251
YILTVPGHLDEMQLDIQARYIYGKPVQGVAYVRFGLLDEDGKKTFFRGLE            300  ...  301

SQTKLVNGQSHISLSKAEFQDALEKLNMGITDLQGLRLYVAAAIIESPGG            350
                                                              301
SQTKLVNGQSHISLSKAEFQDALEKLNMGITDLQGLRLYVAAAIIESPGG            350  ...  351

EMEEAELTSWYFVSSPFSLDLSKTKRHLVPGAPFLLQALVREMSGSPASG            400
                                                              351
EMEEAELTSWYFVSSPFSLDLSKTKRHLVPGAPFLLQALVREMSGSPASG            400  ...  401

IPVKVSATVSSPGSVPEVQDIQQNTDGSGQVSIPIIIPQTISELQLSVSA            450
                                                              401
IPVKVSATVSSPGSVPEVQDIQQNTDGSGQVSIPIIIPQTISELQLSVSA            450  ...  451

GSPHPAIARLTVAAPPSGGPGFLSIERPDSRPPRVGDTLNLNLRAVGSGA            500
                                                              451
GSPHPAIARLTVAAPPSGGPGFLSIERPDSRPPRVGDTLNLNLRAVGSGA            500  ...  501

TFSHYYYMILSRGQIVFMNREPKRTLTSVSVFVDHHLAPSFYFVAFYYHG            550
                                                              501
TFSHYYYMILSRGQIVFMNREPKRTLTSVSVFVDHHLAPSFYFVAFYYHG            550  ...  551

DRPVANSLRVDVQAGACEGKLELSVDGAKQYRNGESVKLHLETDSLALVA            600
                                                              551
DHPVANSLRVDVQAGACEGKLELSVDGAKQYRNGESVKLHLETDSLALVA            600  ...  601

LGALDTALYAAGSKSHKPLNMGKVFEAMNSYDLGCGPGGGDSALQVFQAA            650
                                                              601
LGALDTALYAAGSKSHKPLNMGKVFEAMNSYDLGCGPGGGDSALQVFQAA            650  ...  651

GLAFSDGDQWTLSRKRLSCPKEKTTRKKRNVNFQKAINEKLGQYASPTAK            700
                                                              651
GLAFSDGDQWTLSRKRLSCPKEKTTRKKRNVNFQKAINEKLGQYASPTAK            700  ...  701

RCCQDGVTRLPMMRSCEQRAARVQQPDCREPFLSCCQFAESLRKKSRDKG            750
                                                              701
RCCQDGVTRLPMMRSCEQRAARVQQPDCREPFLSCCQFAESLRKKSRDKG            750  ...  751

QAGLQRALEILQEEDLIDEDDIPVRSFFPENWLWRVETVDRFQILTLWLP            800
                                                              751
QAGLQRALEILQEEDLIDEDDIPVRSFFPENWLWRVETVDRFQILTLWLP            800  ...  801

DSLTTWEIHGLSLSKTKGLCVATPVQLRVFREFHLHLRLPMSVRRFEQLE            850
                                                              801
DSLTTWEIHGLSLSKTKGLCVATPVQLRVFREFHLHLRLPMSVRRFEQLE            850  ...  851

LRPVLYNYLDKNLTVSVHVSPVEGLCLAGGGGLAQQVLVPAGSARPVAFS            900
                                                              851
LRPVLYNYLDKNLTVSVHVSPVEGLCLAGGGGLAQQVLVPAGSARPVAFS            900  ...  901

VVPTAAAAVSLKVVARGSFEFPVGDAVSKVLQIEKEGAIHREELVYELNP            950
                                                              901
VVPTAAAAVSLKVVARGSFEFPVGDAVSKVLQIEKEGAIHREELVYELNP            950  ...  951

LDHRGRTLEIPGNSDPNMIPDGDFNSYVRVTASDPLDTLGSEGALSPGGV            1000
                                                              951
LDHRGRTLEIPGNSDPNMIPDGDFNSYVRVTASDPLDTLGSEGALSPGGV            1000 ...  1001

ASLLRLPRGCGEQTMIYLAPTLAASRYLDKTEQWSTLPPETKDHAVDLIQ            1050
                                                              1001
ASLLRLPRGCGEQTMIYLAPTLAASRYLDKTEQWSTLPPETKDHAVDLIQ            1050 ...  1051

KGYMRIQQFRKADGSYAAWLSRDSSTWLTAFVLKVLSLAQEQVGGSPEKL            1100
```

```
                                      -continued
|||||||||||||||||||||||||||||||||||||||||||           1051
KGYMRIQQFRKADGSYAAWLSRDSSTWLTAFVLKVLSLAQEQVGGSPEKL    1100 ... 1101

QETSNWLLSQQQADGSFQDPCPVLDRSMQGGLVGNDETVALTAFVTIALH    1150
|||||||||||||||||||||||||||||||||||||||||||||||||    1101
QETSNWLLSQQQADGSFQDPCPVLDRSMQGGLVGNDETVALTAFVTIALH    1150 ... 1151

HGLAVFQDEGAEPLKQRVEASISKASSFLGEKASAGLLGAHAAAITAYAL    1200
|||||||||||||||||||||||||||||||||||||||||||||||||    1151
HGLAVFQDEGAEPLKQRVEASISKASSFLGEKASAGLLGAHAAAITAYAL    1200 ... 1201

TLTKAPADLRGVAHNNLMAMAQETGDNLYWGSVTGSQSNAVSPTPAPRNP    1250
|||||||||||||||||||||||||||||||||||||||||||||||||    1201
TLTKAPADLRGVAHNNLMAMAQETGDNLYWGSVTGSQSNAVSPTPAPRNP    1250 ... 1251

SDPMPQAPALWIETTAYALLHLLLHEGKAEMADQAAAWLTRQGSFQGGFR    1300
|||||||||||||||||||||||||||||||||||||||||||||||||    1251
SDPMPQAPALWIETTAYALLHLLLHEGKAEMADQAAAWLTRQGSFQGGFR    1300 ... 1301

STQDTVIALDALSAYWIASHTTEERGLNVTLSSTGRNGFKSHALQLNNRQ    1350
|||||||||||||||||||||||||||||||||||||||||||||||||    1301
STQDTVIALDALSAYWIASHTTEERGLNVTLSSTGRNGFKSHALQLNNRQ    1350 ... 1351

IRGLEEELQFSLGSKINVKVGGNSKGTLKVLRTYNVLDMKNTTCQDLQIE    1400
|||||||||||||||||||||||||||||||||||||||||||||||||    1351
IRGLEEELQFSLGSKINVKVGGNSKGTLKVLRTYNVLDMKNTTCQDLQIE    1400 ... 1401

VTVKGHVEYTMEANEDYEDYEYDELPAKDDPDAPLQPVTPLQLFEGRRNR    1450
|||||||||||||||||||||||||||||||||||||||||||||||||    1401
VTVKGHVEYTMEANEDYEDYEYDELPAKDDPDAPLQPVTPLQLFEGRRNR    1450 ... 1451

RRREAPKVVEEQESRVHYTVCIWRNGKVGLSGMAIADVTLLSGFHALRAD    1500
|||||||||||||||||||||||||||||||||||||||||||||||||    1451
RRREAPKVVEEQESRVHYTVCIWRNGKVGLSGMAIADVTLLSGFHALRAD    1500 ... 1501

LEKLTSLSDRYVSHFETEGPHVLLYFDSVPTSRECVGFEAVQEVPVGLVQ    1550
|||||||||||||||||||||||||||||||||||||||||||||||||    1501
LEKLTSLSDRYVSHFETEGPHVLLYFDSVPTSRECVGFEAVQEVPVGLVQ    1550 ... 1551

PASATLYDYYNPERRCSVFYGAPSKSRLLATLCSAEVCQCAEG           1593
||||||||||||||||||||||||||||||||||||||||||           1551
PASATLYDYYNPERRCSVFYGAPSKSRLLATLCSAEVCQCAEG           1593
```

Sequence name: CO4_HUMAN_V3 (SEQ ID NO:487)

Sequence documentation:

Alignment of: HSCOC4_PEA.sub.--1_P30 (SEQ ID NO:501).times.CO4_HUMAN_V3 (SEQ ID NO:487).

Alignment segment 1/1: TABLE-US-00869 Quality: 11940.00 Escore: 0 Matching length: 1232 Total length: 1232 Matching Percent 100.00 Matching Percent 100.00 Similarity: Identity: Total Percent Similarity: 100.00 Total Percent Identity: 100.00 Gaps: 0

```
Alignment TABLE-US-00870 ... 1
MRLLWGLTWASSFFTLSLQKPRLLLFSPSVVHLGVPLSVGVQLQDVPRGQ    50
|||||||||:||||||||||||||||||||||||||||||||||||||     1
MRLLWGLIWASSFFTLSLQKPRLLLFSPSVVHLGVPLSVGVQLQDVPRGQ    50 ... 51

VVKGSVFLRNPSRNNVPCSPKVDFTLSSERDFALLSLQVPLKDAKSCGLH    100
|||||||||||||||||||||||||||||||||||||||||||||||||    51
VVKGSVFLRNPSRNNVPCSPKVDFTLSSERDFALLSLQVPLKDAKSCGLH    100 ... 101

QLLRGPEVQLVAHSPWLKDSLSRTTNIQGINLLFSSRRGRLFLQTDQPIY    150
|||||||||||||||||||||||||||||||||||||||:|||||||||    101
QLLRGPEVQLVAHSPWLKDSLSRTTNIQGINLLFSSRRGHLFLQTDQPIY    150 ... 151

NPGQRVRYRVFALDQKMRPSTDTITVMVENSHGLRVRKKEVYMPSSIFQD    200
|||||||||||||||||||||||||||||||||||||||||||||||||    151
NPGQRVRYRVFALDQKMRPSTDTITVMVENSHGLRVRKKEVYMPSSIFQD    200 ... 201

DFVIPDISEPGTWKISARFSDGLESNSSTQFEVKKYVLPNFEVKITPGKP    250
|||||||||||||||||||||||||||||||||||||||||||||||||    201
DFVIPDISEPGTWKISARFSDGLESNSSTQFEVKKYVLPNFEVKITPGKP    250 ... 251

YILTVPGHLDEMQLDIQARYIYGKPVQGVAYVRFGLLDEDGKKTFFRGLE    300
|||||||||||||||||||||||||||||||||||||||||||||||||    251
YILTVPGHLDEMQLDIQARYIYGKPVQGVAYVRFGLLDEDGKKTFFRGLE    300 ... 301

SQTKLVNGQSHISLSKAEFQDALEKLNMGITDLQGLRLYVAAAIIESPGG    350
|||||||||||||||||||||||||||||||||||||||||||||||||    301
```

-continued

```
SQTKLVNGQSHISLSKAEFQDALEKLNMGITDLQGLRLYVAAAIIESPGG    350 ... 351

EMEEAELTSWYFVSSPFSLDLSKTKRHLVPGAPFLLQALVREMSGSPASG    400
||||||||||||||||||||||||||||||||||||||||||||||||||    351
EMEEAELTSWYFVSSPFSLDLSKTKRHLVPGAPFLLQALVREMSGSPASG    400 ... 401

IPVKVSATVSSPGSVPEVQDIQQNTDGSGQVSIPIIIPQTISELQLSVSA    450
||||||||||||||||||||||||||||||||||||||||||||||||||    401
IPVKVSATVSSPGSVPEVQDIQQNTDGSGQVSIPIIIPQTISELQLSVSA    450 ... 451

GSPHPAIARLTVAAPPSGGPGFLSIERPDSRPPRVGDTLNLNLRAVGSGA    500
||||||||||||||||||||||||||||||||||||||||||||||||||    451
GSPHPAIARLTVAAPPSGGPGFLSIERPDSRPPRVGDTLNLNLRAVGSGA    500 ... 501

TFSHYYYMILSRGQIVFMNREPKRTLTSVSVFVDHHLAPSFYFVAFYYHG    550
||||||||||||||||||||||||||||||||||||||||||||||||||    501
TFSHYYYMILSRGQIVFMNREPKRTLTSVSVFVDHHLAPSFYFVAFYYHG    550 ... 551

DRPVANSLRVDVQAGACEGKLELSVDGAKQYRNGESVKLHLETDSLALVA    600
 ||||||||||||||||||||||||||||||||||||||||||||||||    551
DHPVANSLRVDVQAGACEGKLELSVDGAKQYRNGESVKLHLETDSLALVA    600 ... 601

LGALDTALYAAGSKSHKPLNMGKVFEAMNSYDLGCGPGGGDSALQVFQAA    650
||||||||||||||||||||||||||||||||||||||||||||||||||    601
LGALDTALYAAGSKSHKPLNMGKVFEAMNSYDLGCGPGGGDSALQVFQAA    650 ... 651

GLAFSDGDQWTLSRKRLSCPKEKTTRKKRNVNFQKAINEKLGQYASPTAK    700
||||||||||||||||||||||||||||||||||||||||||||||||||    651
GLAFSDGDQWTLSRKRLSCPKEKTTRKKRNVNFQKAINEKLGQYASPTAK    700 ... 701

RCCQDGVTRLPMMRSCEQRAARVQQPDCREPFLSCCQFAESLRKKSRDKG    750
||||||||||||||||||||||||||||||||||||||||||||||||||    701
RCCQDGVTRLPMMRSCEQRAARVQQPDCREPFLSCCQFAESLRKKSRDKG    750 ... 751

QAGLQRALEILQEEDLIDEDDIPVRSFFPENWLWRVETVDRFQILTLWLP    800
||||||||||||||||||||||||||||||||||||||||||||||||||    751
QAGLQRALEILQEEDLIDEDDIPVRSFFPENWLWRVETVDRFQILTLWLP    800 ... 801

DSLTTWEIHGLSLSKTKGLCVATPVQLRVFREFHLHLRLPMSVRRFEQLE    850
||||||||||||||||||||||||||||||||||||||||||||||||||    801
DSLTTWEIHGLSLSKTKGLCVATPVQLRVFREFHLHLRLPMSVRRFEQLE    850 ... 851

LRPVLYNYLDKNLTVSVHVSPVEGLCLAGGGGLAQQVLVPAGSARPVAFS    900
||||||||||||||||||||||||||||||||||||||||||||||||||    851
LRPVLYNYLDKNLTVSVHVSPVEGLCLAGGGGLAQQVLVPAGSARPVAFS    900 ... 901

VVPTAAAAVSLKVVARGSFEFPVGDAVSKVLQIEKEGAIHREELVYELNP    950
||||||||||||||||||||||||||||||||||||||||||||||||||    901
VVPTAAAAVSLKVVARGSFEFPVGDAVSKVLQIEKEGAIHREELVYELNP    950 ... 951

LDHRGRTLEIPGNSDPNMIPDGDFNSYVRVTASDPLDTLGSEGALSPGGV    1000
||||||||||||||||||||||||||||||||||||||||||||||||||    951
LDHRGRTLEIPGNSDPNMIPDGDFNSYVRVTASDPLDTLGSEGALSPGGV    1000 ... 1001

ASLLRLPRGCGEQTMIYLAPTLAASRYLDKTEQWSTLPPETKDHAVDLIQ    1050
||||||||||||||||||||||||||||||||||||||||||||||||||    1001
ASLLRLPRGCGEQTMIYLAPTLAASRYLDKTEQWSTLPPETKDHAVDLIQ    1050 ... 1051

KGYMRIQQFRKADGSYAAWLSRDSSTWLTAFVLKVLSLAQEQVGGSPEKL    1100
||||||||||||||||||||||||||||||||||||||||||||||||||    1051
KGYMRIQQFRKADGSYAAWLSRDSSTWLTAFVLKVLSLAQEQVGGSPEKL    1100 ... 1101

QETSNWLLSQQQADGSFQDPCPVLDRSMQGGLVGNDETVALTAFVTIALH    1150
||||||||||||||||||||||||||||||||||||||||||||||||||    1101
QETSNWLLSQQQADGSFQDPCPVLDRSMQGGLVGNDETVALTAFVTIALH    1150 ... 1151

HGLAVFQDEGAEPLKQRVEASISKASSFLGEKASAGLLGAHAAAITAYAL    1200
||||||||||||||||||||||||||||||||||||||||||||||||||    1151
HGLAVFQDEGAEPLKQRVEASISKASSFLGEKASAGLLGAHAAAITAYAL    1200 ... 1201

TLTKAPADLRGVAHNNLMAMAQETGDNLYWGS    1232
|||||||||||||||||||||||||||||||    1201
TLTKAPADLRGVAHNNLMAMAQETGDNLYWGS    1232
```

Sequence name: CO4_HUMAN (SEQ ID NQ:485)

Sequence documentation:

Alignment of: HSCOC4_PEA.sub.--1_P38 (SEQ ID NO:502).times.CO4_HUMAN (SEQ (SEQ ID NO:485).

Alignment segment 1/1: TABLE-US-00871 Quality: 7969.00 Escore: 0 Matching length: 818 Total length: 818 Matching Percent 100.00 Matching Percent Identity: 100.00 Similarity: Total Percent Similarity: 100.00 Total Percent Identity: 100.00 Gaps: 0

```
Alignment TABLE-US-00872 . . . 1
MRLLWGLIWASSFFTLSLQKPRLLLFSPSVVHLGVPLSVGVQLQDVPRGQ   50
||||||||||||||||||||||||||||||||||||||||||||||||||    1
MRLLWGLIWASSFFTLSLQKPRLLLFSPSVVHLGVPLSVGVQLQDVPRGQ   50 . . .  51

VVKGSVFLRNPSRNNVPCSPKVDFTLSSERDFALLSLQVPLKDAKSCGLH  100
||||||||||||||||||||||||||||||||||||||||||||||||||   51
VVKGSVFLRNPSRNNVPCSPKVDFTLSSERDFALLSLQVPLKDAKSCGLH  100 . . . 101

QLLRGPEVQLVAHSPWLKDSLSRTTNIQGINLLFSSRRGRLFLQTDQPIY  150
|||||||||||||||||||||||||||||||||||||||           101
QLLRGPEVQLVAHSPWLKDSLSRTTNIQGINLLFSSRRGHLFLQTDQPIY  150 . . . 151

NPGQRVRYRVFALDQKMRPSTDTITVMVENSHGLRVRKKEVYMPSSIFQD  200
||||||||||||||||||||||||||||||||||||||||||||||||||  151
NPGQRVRYRVFALDQKMRPSTDTITVMVENSHGLRVRKKEVYMPSSIFQD  200 . . . 201

DFVIPDISEPGTWKISARFSDGLESNSSTQFEVKKYVLPNFEVKITPGKP  250
||||||||||||||||||||||||||||||||||||||||||||||||||  201
DFVIPDISEPGTWKISARFSDGLESNSSTQFEVKKYVLPNFEVKITPGKP  250 . . . 251

YILTVPGHLDEMQLDIQARYIYGKPVQGVAYVRFGLLDEDGKKTFFRGLE  300
||||||||||||||||||||||||||||||||||||||||||||||||||  251
YILTVPGHLDEMQLDIQARYIYGKPVQGVAYVRFGLLDEDGKKTFFRGLE  300 . . . 301

SQTKLVNGQSHISLSKAEFQDALEKLNMGITDLQGLRLYVAAAIIESPGG  350
||||||||||||||||||||||||||||||||||||||||||||||||||  301
SQTKLVNGQSHISLSKAEFQDALEKLNMGITDLQGLRLYVAAAIIESPGG  350 . . . 351

EMEEAELTSWYFVSSPFSLDLSKTKRHLVPGAPFLLQALVREMSGSPASG  400
||||||||||||||||||||||||||||||||||||||||||||||||||  351
EMEEAELTSWYFVSSPFSLDLSKTKRHLVPGAPFLLQALVREMSGSPASG  400 . . . 401

IPVKVSATVSSPGSVPEVQDIQQNTDGSGQVSIPIIIPQTISELQLSVSA  450
||||||||||||||||||||||||||||||||||||||||||||||||||  401
IPVKVSATVSSPGSVPEVQDIQQNTDGSGQVSIPIIIPQTISELQLSVSA  450 . . . 451

GSPHPAIARLTVAAPPSGGPGFLSIERPDSRPPRVGDTLNLNLRAVGSGA  500
||||||||||||||||||||||||||||||||||||||||||||||||||  451
GSPHPAIARLTVAAPPSGGPGFLSIERPDSRPPRVGDTLNLNLRAVGSGA  500 . . . 501

TFSHYYYMILSRGQIVFMNREPKRTLTSVSVFVDHHLAPSFYFVAFYYHG  550
||||||||||||||||||||||||||||||||||||||||||||||||||  501
TFSHYYYMILSRGQIVFMNREPKRTLTSVSVFVDHHLAPSFYFVAFYYHG  550 . . . 551

DHPVANSLRVDVQAGACEGKLELSVDGAKQYRNGESVKLHLETDSLALVA  600
||||||||||||||||||||||||||||||||||||||||||||||||||  551
DHPVANSLRVDVQAGACEGKLELSVDGAKQYRNGESVKLHLETDSLALVA  600 . . . 601

LGALDTALYAAGSKSHKPLNMGKVFEAMNSYDLGCGPGGGDSALQVFQAA  650
||||||||||||||||||||||||||||||||||||||||||||||||||  601
LGALDTALYAAGSKSHKPLNMGKVFEAMNSYDLGCGPGGGDSALQVFQAA  650 . . . 651

GLAFSDGDQWTLSRKRLSCPKEKTTRKKRNVNFQKAINEKLGQYASPTAK  700
||||||||||||||||||||||||||||||||||||||||||||||||||  651
GLAFSDGDQWTLSRKRLSCPKEKTTRKKRNVNFQKAINEKLGQYASPTAK  700 . . . 701

RCCQDGVTRLPMMRSCEQRAARVQQPDCREPFLSCCQFAESLRKKSRDKG  750
||||||||||||||||||||||||||||||||||||||||||||||||||  701
RCCQDGVTRLPMMRSCEQRAARVQQPDCREPFLSCCQFAESLRKKSRDKG  750 . . . 751

QAGLQRALEILQEEDLIDEDDIPVRSFFPENWLWRVETVDRFQILTLWLP  800
||||||||||||||||||||||||||||||||||||||||||||||||||  751
QAGLQRALEILQEEDLIDEDDIPVRSFFPENWLWRVETVDRFQILTLWLP  800 . . . 801

DSLTTWEIHGLSLSKTKG                                  818
||||||||||||||||||                                  801
DSLTTWEIHGLSLSKTKG                                  818
```

Sequence name: CO4_HUMAN (SEQ ID NO:485)
Sequence documentation:

Alignment of: HSCOC4_PEA.sub.--1_P39 (SEQ ID NO:503).times.CO4_HUMAN (SEQ ID NO:485).

Alignment segment 1/1: TABLE-US-00873 Quality: 3766.00 Escore: 0 Matching length: 387 Total length: 387 Matching Percent 100.00 Matching Percent Identity: 100.00 Similarity: Total Percent Similarity: 100.00 Total Percent Identity: 100.00 Gaps: 0

```
Alignment TABLE-US-00874 . . . 1
MRLLWGLTWASSFFTLSLQKPRLLLFSPSVVHLGVPLSVGVQLQDVPRGQ  50
||||||||| ||||||||||||||||||||||||||||||||||||||||   1                    51
MRLLWGLIWASSFFTLSLQKPRLLLFSPSVVHLGVPLSVGVQLQDVPRGQ  50  . . .

VVKGSVFLRNPSRNNVPCSPKVDFTLSSERDFALLSLQVPLKDAKSCGLH 100
||||||||||||||||||||||||||||||||||||||||||||||||||  51                   101
VVKGSVFLRNPSRNNVPCSPKVDFTLSSERDFALLSLQVPLKDAKSCGLH 100  . . .

QLLRGPEVQLVAHSPWLKDSLSRTTNIQGINLLFSSRRGRLFLQTDQPIY 150
|||||||||||||||||||||||||||||||||||||| |||||||||| 101                   151
QLLRGPEVQLVAHSPWLKDSLSRTTNIQGINLLFSSRRGHLFLQTDQPIY 150  . . .

NPGQRVRYRVFALDQKMRPSTDTITVMVENSHGLRVRKKEVYMPSSIFQD 200
|||||||||||||||||||||||||||||||||||||||||||||||||| 151                  201
NPGQRVRYRVFALDQKMRPSTDTITVMVENSHGLRVRKKEVYMPSSIFQD 200  . . .

DFVIPDISEPGTWKISARFSDGLESNSSTQFEVKKYVLPNFEVKITPGKP 250
|||||||||||||||||||||||||||||||||||||||||||||||||| 201                  251
DFVIPDISEPGTWKISARFSDGLESNSSTQFEVKKYVLPNFEVKITPGKP 250  . . .

YILTVPGHLDEMQLDIQARYIYGKPVQGVAYVRFGLLDEDGKKTFFRGLE 300
|||||||||||||||||||||||||||||||||||||||||||||||||| 251                  301
YILTVPGHLDEMQLDIQARYIYGKPVQGVAYVRFGLLDEDGKKTFFRGLE 300  . . .

SQTKLVNGQSHISLSKAEFQDALEKLNMGITDLQGLRLYVAAAIIESPGG 350
|||||||||||||||||||||||||||||||||||||||||||||||||| 301                  351
SQTKLVNGQSHISLSKAEFQDALEKLNMGITDLQGLRLYVAAAIIESPGG 350  . . .

EMEEAELTSWYFVSSPFSLDLSKTKRHLVPGAPFLLQ              387
||||||||||||||||||||||||||||||||||||               351
EMEEAELTSWYFVSSPFSLDLSKTKRHLVPGAPFLLQ              387
```

Sequence name: CO4_HUMAN (SEQ ID NO:485)
Sequence documentation:
Alignment of: HSCOC4_PEA.sub.--1_P40 (SEQ ID NO:504).times.CO4_HUMAN (SEQ ID NO:485).
Alignment segment 1/1: TABLE-US-00875 Quality: 2309.00 Escore: 0 Matching length: 236 Total length: 236 Matching Percent 100.00 Matching Percent Identity: 100.00 Similarity: Total Percent Similarity: 100.00 Total Percent Identity: 100.00 Gaps: 0

```
Alignment: TABLE-US-00876 . . . 1
MRLLWGLTWASSFFTLSLQKPRLLLFSPSVVHLGVPLSVGVQLQDVPRGQ  50
||||||||| ||||||||||||||||||||||||||||||||||||||||   1                    51
MRLLWGLIWASSFFTLSLQKPRLLLFSPSVVHLGVPLSVGVQLQDVPRGQ  50  . . .

VVKGSVFLRNPSRNNVPCSPKVDFTLSSERDFALLSLQVPLKDAKSCGLH 100
||||||||||||||||||||||||||||||||||||||||||||||||||  51                   101
VVKGSVFLRNPSRNNVPCSPKVDFTLSSERDFALLSLQVPLKDAKSCGLH 100  . . .

QLLRGPEVQLVAHSPWLKDSLSRTTNIQGINLLFSSRRGRLFLQTDQPIY 150
|||||||||||||||||||||||||||||||||||||| |||||||||| 101                   151
QLLRGPEVQLVAHSPWLKDSLSRTTNIQGINLLFSSRRGHLFLQTDQPIY 150  . . .

NPGQRVRYRVFALDQKMRPSTDTITVMVENSHGLRVRKKEVYMPSSIFQD 200
|||||||||||||||||||||||||||||||||||||||||||||||||| 151                  201
NPGQRVRYRVFALDQKMRPSTDTITVMVENSHGLRVRKKEVYMPSSIFQD 200  . . .

DFVIPDISEPGTWKISARFSDGLESNSSTQFEVKKY                236
||||||||||||||||||||||||||||||||||||                201
DFVIPDISEPGTWKISARFSDGLESNSSTQFEVKKY                236
```

Sequence name: CO4_HUMAN_V1 (SEQ ID NO:486)
Sequence documentation:
Alignment of: HSCOC4_PEA.sub.--1_P41 (SEQ ID NO:505).times.CO4_HUMAN_V1 (SEQ ID NO:486).

Alignment segment 1/1: TABLE-US-00877 Quality: 14831.00 Escore: 0 Matching length: 1529 Total length: 1529 Matching Percent 100.00 Matching Percent 100.00 Similarity: Identity: Total Percent Similarity: 100.00 Total Percent Identity: 100.00 Gaps: 0

```
Alignment TABLE-US-00878 . . . 1
MRLLWGLIWASSFFTLSLQKPRLLLFSPSVVHLGVPLSVGVQLQDVPRGQ    50
||||||||||||||||||||||||||||||||||||||||||||||||||    1
MRLLWGLIWASSFFTLSLQKPRLLLFSPSVVHLGVPLSVGVQLQDVPRGQ    50 . . . 51

VVKGSVFLRNPSRNNVPCSPKVDFTLSSERDFALLSLQVPLKDAKSCGLH   100
||||||||||||||||||||||||||||||||||||||||||||||||||   51
VVKGSVFLRNPSRNNVPCSPKVDFTLSSERDFALLSLQVPLKDAKSCGLH   100 . . . 101

QLLRGPEVQLVAHSPWLKDSLSRTTNIQGINLLFSSRRGHLFLQTDQPIY   150
||||||||||||||||||||||||||||||||||||||||||||||||||   101
QLLRGPEVQLVAHSPWLKDSLSRTTNIQGINLLFSSRRGHLFLQTDQPIY   150 . . . 151

NPGQRVRYRVFALDQKMRPSTDTITVMVENSHGLRVRKKEVYMPSSIFQD   200
||||||||||||||||||||||||||||||||||||||||||||||||||   151
NPGQRVRYRVFALDQKMRPSTDTITVMVENSHGLRVRKKEVYMPSSIFQD   200 . . . 201

DFVIPDISEPGTWKISARFSDGLESNSSTQFEVKKYVLPNFEVKITPGKP   250
||||||||||||||||||||||||||||||||||||||||||||||||||   201
DFVIPDISEPGTWKISARFSDGLESNSSTQFEVKKYVLPNFEVKITPGKP   250 . . . 251

YILTVPGHLDEMQLDIQARYIYGKPVQGVAYVRFGLLDEDGKKTFFRGLE   300
||||||||||||||||||||||||||||||||||||||||||||||||||   251
YILTVPGHLDEMQLDIQARYIYGKPVQGVAYVRFGLLDEDGKKTFFRGLE   300 . . . 301

SQTKLVNGQSHISLSKAEFQDALEKLNMGITDLQGLRLYVAAAIIESPGG   350
||||||||||||||||||||||||||||||||||||||||||||||||||   301
SQTKLVNGQSHISLSKAEFQDALEKLNMGITDLQGLRLYVAAAIIESPGG   350 . . . 351

EMEEAELTSWYFVSSPFSLDLSKTKRHLVPGAPELLQALVREMSGSPASG   400
||||||||||||||||||||||||||||||||||||||||||||||||||   351
EMEEAELTSWYFVSSPFSLDLSKTKRHLVPGAPELLQALVREMSGSPASG   400 . . . 401

IPVKVSATVSSPGSVPEVQDIQQNTDGSGQVSIPIIIPQTISELQLSVSA   450
||||||||||||||||||||||||||||||||||||||||||||||||||   401
IPVKVSATVSSPGSVPEVQDIQQNTDGSGQVSIPIIIPQTISELQLSVSA   450 . . . 451

GSPHPAIARLTVAAPPSGGPGFLSIERPDSRPPRVGDTLNLNLRAVGSGA   500
||||||||||||||||||||||||||||||||||||||||||||||||||   451
GSPHPAIARLTVAAPPSGGPGFLSIERPDSRPPRVGDTLNLNLRAVGSGA   500 . . . 501

TFSHYYYMILSRGQIVFMNREPKRTLTSVSVFVDHHLAPSFYPVAFYYHG   550
|||||||||||||||||||||||||||||||||||||||||| |||||||   501
TFSHYYYMILSRGQIVFMNREPKRTLTSVSVFVDHHLAPSFYFVAFYYHG   550 . . . 551

DHPVANSLRVDVQAGACEGKLELSVDGAKQYRNGESVKLHLETDSLALVA   600
||||||||||||||||||||||||||||||||||||||||||||||||||   551
DHPVANSLRVDVQAGACEGKLELSVDGAKQYRNGESVKLHLETDSLALVA   600 . . . 601

LGALDTALYAAGSKSHKPLNMGKVFEAMNSYDLGCGPGGGDSALQVFQAA   650
||||||||||||||||||||||||||||||||||||||||||||||||||   601
LGALDTALYAAGSKSHKPLNMGKVFEAMNSYDLGCGPGGGDSALQVFQAA   650 . . . 651

GLAFSDGDQWTLSRKRLSCPKEKTTRKKRNVNFQKAINEKLGQYASPTAK   700
||||||||||||||||||||||||||||||||||||||||||||||||||   651
GLAFSDGDQWTLSRKRLSCPKEKTTRKKRNVNFQKAINEKLGQYASPTAK   700 . . . 701

RCCQDGVTRLPMMRSCEQRAARVQQPDCREPFLSCCQFAESLRKKSRDKG   750
||||||||||||||||||||||||||||||||||||||||||||||||||   701
RCCQDGVTRLPMMRSCEQRAARVQQPDCREPFLSCCQFAESLRKKSRDKG   750 . . . 751

QAGLQRALEILQEEDLIDEDDIPVRSFFPENWLWRVETVDRFQILTLWLP   800
||||||||||||||||||||||||||||||||||||||||||||||||||   751
QAGLQRALEILQEEDLIDEDDIPVRSFFPENWLWRVETVDRFQILTLWLP   800 . . . 801

DSLTTWEIHGLSLSKTKGLCVATPVQLRVFREFHLHLRLPMSVRRFEQLE   850
||||||||||||||||||||||||||||||||||||||||||||||||||   801
DSLTTWEIHGLSLSKTKGLCVATPVQLRVFREFHLHLRLPMSVRRFEQLE   850 . . . 851

LRPVLYNYLDKNLTVSVRVSPVEGLCLAGGGGLAQQVLVPAGSARPVAFS   900
|||||||||||||||||||| |||||||||||||||||||||||||||||   851
LRPVLYNYLDKNLTVSVHVSPVEGLCLAGGGGLAQQVLVPAGSARPVAFS   900 . . . 901

VVPTAAAAVSLKVVARGSFEFPVGDAVSKVLQTEKEGAIHREELVYELNP   950
||||||||||||||||||||||||||||||||||||||||||||||||||   901
VVPTAAAAVSLKVVARGSFEFPVGDAVSKVLQTEKEGAIHREELVYELNP   950 . . . 951

LDHRGRTLEIPGNSDPNMIPDGDFNSYVRVTASDPLDTLGSEGALSPGGV  1000
||||||||||||||||||||||||||||||||||||||||||||||||||   951
LDHRGRTLEIPGNSDPNMIPDGDFNSYVRVTASDPLDTLGSEGALSPGGV  1000 . . . 1001
```

-continued

```
ASLLRLPRGCGEQTMIYLAPTLAASRYLDKTEQWSTLPPETKDHAVDLIQ  1050
||||||||||||||||||||||||||||||||||||||||||||||||||  1001
ASLLRLPRGCGEQTMIYLAPTLAASRYLDKTEQWSTLPPETKDHAVDLIQ  1050 . . . 1051

KGYMRIQQFRKADGSYAAWLSRDSSTWLTAFVLKVLSLAQEQVGGSPEKL  1100
||||||||||||||||||||||||||||||||||||||||||||||||||  1051
KGYMRIQQFRKADGSYAAWLSRDSSTWLTAFVLKVLSLAQEQVGGSPEKL  1100 . . . 1101

QETSNWLLSQQQADGSFQDPCPVLDRSMQGGLVGNDETVALTAFVTIALH  1150
||||||||||||||||||||||||||||||||||||||||||||||||||  1101
QETSNWLLSQQQADGSFQDPCPVLDRSMQGGLVGNDETVALTAFVTIALH  1150 . . . 1151

HGLAVFQDEGAEPLKQRVEASISKASSFLGEKASAGLLGAHAAAITAYAL  1200
||||||||||||||||||||||||||||||||||||||||||||||||||  1151
HGLAVFQDEGAEPLKQRVEASISKASSFLGEKASAGLLGAHAAAITAYAL  1200 . . . 1201

TLTKAPADLRGVAHNNLMAMAQETGDNLYWGSVTGSQSNAVSPTPAPRNP  1250
||||||||||||||||||||||||||||||||||||||||||||||||||  1201
TLTKAPADLRGVAHNNLMAMAQETGDNLYWGSVTGSQSNAVSPTPAPRNP  1250 . . . 1251

SDPMPQAPALWIETTAYALLHLLLHEGKAEMADQAAAWLTRQGSFQGGFR  1300
||||||||||||||||||||||||||||||||||||||||||||||||||  1251
SDPMPQAPALWIETTAYALLHLLLHEGKAEMADQAAAWLTRQGSFQGGFR  1300 . . . 1301

STQDTVIALDALSAYWIASHTTEERGLNVTLSSTGRNGFKSHALQLNNRQ  1350
||||||||||||||||||||||||||||||||||||||||||||||||||  1301
STQDTVIALDALSAYWIASHTTEERGLNVTLSSTGRNGFKSHALQLNNRQ  1350 . . . 1351

IRGLEEELQFSLGSKINVKVGGNSKGTLKVLRTYNVLDMKNTTCQDLQIE  1400
||||||||||||||||||||||||||||||||||||||||||||||||||  1351
IRGLEEELQFSLGSKINVKVGGNSKGTLKVLRTYNVLDMKNTTCQDLQIE  1400 . . . 1401

VTVKGHVEYTMEANEDYEDYEYDELPAKDDPDAPLQPVTPLQLFEGRRNR  1450
||||||||||||||||||||||||||||||||||||||||||||||||||  1401
VTVKGHVEYTMEANEDYEDYEYDELPAKDDPDAPLQPVTPLQLFEGRRNR  1450 . . . 1451

RRREAPKVVEEQESRVHYTVCIWRNGKVGLSGMAIADVTLLSGFHALRAD  1500
||||||||||||||||||||||||||||||||||||||||||||||||||  1451
RRREAPKVVEEQESRVHYTVCIWRNGKVGLSGMAIADVTLLSGFHALRAD  1500 . . . 1501

LEKLTSLSDRYVSHFETEGPHVLLYFDSV                       1529
|||||||||||||||||||||||||||||                       1501
LEKLTSLSDRYVSHFETEGPHVLLYFDSV                       1529
```

Sequence name: CO4_HUMAN_V1 (SEQ ID NO:486)

Sequence documentation:

Alignment of: HSCOC4_PEA.sub.--1_P42 (SEQ ID NO:506).times.CO4_HUMAN_V1 (SEQ ID NO:486).

Alignment segment 1/1: TABLE-US-00879 Quality: 14480.00 Escore: 0 Matching length: 1506 Total length: 1544 Matching Percent 99.93 Matching Percent 99.87 Similarity: Identity: Total Percent Similarity: 97.47 Total Percent Identity: 97.41 Gaps: 1

```
Alignment: TABLE-US-00880 . . . 1
MRLLWGLIWASSFFTLSLQKPRLLLFSPSVVHLGVPLSVGVQLQDVPRGQ   50
||||||||||||||||||||||||||||||||||||||||||||||||||    1
MRLLWGLIWASSFFTLSLQKPRLLLFSPSVVHLGVPLSVGVQLQDVPRGQ   50 . . . 51

VVKGSVFLRNPSRNNVPCSPKVDFTLSSERDFALLSLQVPLKDAKSCGLH  100
||||||||||||||||||||||||||||||||||||||||||||||||||   51
VVKGSVFLRNPSRNNVPCSPKVDFTLSSERDFALLSLQVPLKDAKSCGLH  100 . . . 101

QLLRGPEVQLVAHSPWLKDSLSRTTNIQGINLLFSSRRGHLFLQTDQPIY  150
||||||||||||||||||||||||||||||||||||||||||||||||||  101
QLLRGPEVQLVAHSPWLKDSLSRTTNIQGINLLFSSRRGHLFLQTDQPIY  150 . . . 151

NPGQRVRYRVFALDQKMRPSTDTITVMVENSHGLRVRKKEVYMPSSIFQD  200
||||||||||||||||||||||||||||||||||||||||||||||||||  151
NPGQRVRYRVFALDQKMRPSTDTITVMVENSHGLRVRKKEVYMPSSIFQD  200 . . . 201

DFVIPDISEPGTWKISARFSDGLESNSSTQFEVKKYVLPNFEVKITPGKP  250
||||||||||||||||||||||||||||||||||||||||||||||||||  201
DFVIPDISEPGTWKISARFSDGLESNSSTQFEVKKYVLPNFEVKITPGKP  250 . . . 251

YILTVPGHLDEMQLDIQARYIYGKPVQGVAYVRFGLLDEDGKKTFFRGLE  300
||||||||||||||||||||||||||||||||||||||||||||||||||  251
YILTVPGHLDEMQLDIQARYIYGKPVQGVAYVRFGLLDEDGKKTFFRGLE  300 . . . 301
```

```
                           -continued
SQTKLVNGQSHISLSKAEFQDALEKLNMGITDLQGLRLYVAAAIIESPGG   350
|||||||||||||||||||||||||||||||||||||||||||||||||   301
SQTKLVNGQSHISLSKAEFQDALEKLNMGITDLQGLRLYVAAAIIESPGG   350 . . . 351

EMEEAELTSWYFVSSPFSLDLSKTKRHLVPGAPELLQALVREMSGSPASG   400
|||||||||||||||||||||||||||||||||||||||||||||||||   351
EMEEAELTSWYFVSSPFSLDLSKTKRHLVPGAPELLQALVREMSGSPASG   400 . . . 401

IPVKVSATVSSPGSVPEVQDIQQNTDGSGQVSIPIIIPQTISELQLSVSA   450
|||||||||||||||||||||||||||||||||||||||||||||||||   401
IPVKVSATVSSPGSVPEVQDIQQNTDGSGQVSIPIIIPQTISELQLSVSA   450 . . . 451

GSPHPAIARLTVAAPPSGGPGFLSIERPDSRPPRVGDTLNLNLRAVGSGA   500
|||||||||||||||||||||||||||||||||||||||||||||||||   451
GSPHPAIARLTVAAPPSGGPGFLSIERPDSRPPRVGDTLNLNLRAVGSGA   500 . . . 501

TFSHYYYMILSRGQIVFMNREPKRTLTSVSVFVDHHLAPSFYPVAFYYHG   550
|||||||||||||||||||||||||||||||||||||||||||||||||   501
TFSHYYYMILSRGQIVFMNREPKRTLTSVSVFVDHHLAPSFYFVAFYYHG   550 . . . 551

DHPVANSLRVDVQAGACEGKLELSVDGAKQYRNGESVKLHLETDSLALVA   600
|||||||||||||||||||||||||||||||||||||||||||||||||   551
DHPVANSLRVDVQAGACEGKLELSVDGAKQYRNGESVKLHLETDSLALVA   600 . . . 601

LGALDTALYAAGSKSHKPLNMGKVFEAMNSYDLGCGPGGGDSALQVFQAA   650
|||||||||||||||||||||||||||||||||||||||||||||||||   601
LGALDTALYAAGSKSHKPLNMGKVFEAMNSYDLGCGPGGGDSALQVFQAA   650 . . . 651

GLAFSDGDQWTLSRKRLSCPKEKTTRKKRNVNFQKAINEKLGQYASPTAK   700
|||||||||||||||||||||||||||||||||||||||||||||||||   651
GLAFSDGDQWTLSRKRLSCPKEKTTRKKRNVNFQKAINEKLGQYASPTAK   700 . . . 701

RCCQDGVTRLPMMRSCEQRAARVQQPDCREPFLSCCQFAESLRKKSRDKG   750
|||||||||||||||||||||||||||||||||||||||||||||||||   701
RCCQDGVTRLPMMRSCEQRAARVQQPDCREPFLSCCQFAESLRKKSRDKG   750 . . . 751

QAGLQRALEILQEEDLIDEDDIPVRSFFPENWLWRVETVDRFQILTLWLP   800
|||||||||||||||||||||||||||||||||||||||||||||||||   751
QAGLQRALEILQEEDLIDEDDIPVRSFFPENWLWRVETVDRFQILTLWLP   800 . . . 801

DSLTTWEIHGLSLSKTKGLCVATPVQLRVFREFHLHLRLPMSVRRFEQLE   850
|||||||||||||||||||||||||||||||||||||||||||||||||   801
DSLTTWEIHGLSLSKTKGLCVATPVQLRVFREFHLHLRLPMSVRRFEQLE   850 . . . 851

LRPVLYNYLDKNLTVSVRVSPVEGLCLAGGGGLAQQVLVPAGSARPVAFS   900
|||||||||||||||||||||||||||||||||||||||||||||||||   851
LRPVLYNYLDKNLTVSVHVSPVEGLCLAGGGGLAQQVLVPAGSARPVAFS   900 . . . 901

VVPTAAAAVSLKVVARGSFEFPVGDAVSKVLQTEKEGAIHREELVYELNP   950
|||||||||||||||||||||||||||||||||||||||||||||||||   901
VVPTAAAAVSLKVVARGSFEFPVGDAVSKVLQTEKEGAIHREELVYELNP   950 . . . 951

LDHRGRTLEIPGNSDPNMIPDGDFNSYVRVTASDPLDTLGSEGALSPGGV   1000
|||||||||||||||||||||||||||||||||||||||||||||||||   951
LDHRGRTLEIPGNSDPNMIPDGDFNSYVRVTASDPLDTLGSEGALSPGGV   1000 . . . 1001

ASLLRLPRGCGEQTMIYLAPTLAASRYLDKTEQWSTLPPETKDHAVDLIQ   1050
|||||||||||||||||||||||||||||||||||||||||||||||||   1001
ASLLRLPRGCGEQTMIYLAPTLAASRYLDKTEQWSTLPPETKDHAVDLIQ   1050 . . . 1051

KGYMRIQQFRKADGSYAAWLSRDSSTWLTAFVLKVLSLAQEQVGGSPEKL   1100
|||||||||||||||||||||||||||||||||||||||||||||||||   1051
KGYMRIQQFRKADGSYAAWLSRDSSTWLTAFVLKVLSLAQEQVGGSPEKL   1100 . . . 1101

QETSNWLLSQQQADGSFQDPCPVLDRSMQGGLVGNDETVALTAFVTIALH   1150
|||||||||||||||||||||||||||||||||||||||||||||||||   1101
QETSNWLLSQQQADGSFQDPCPVLDRSMQGGLVGNDETVALTAFVTIALH   1150 . . . 1151

HGLAVFQDEGAEPLKQRVEASISKASSFLGEKASAGLLGAHAAAITAYAL   1200
|||||||||||||||||||||||||||||||||||||||||||||||||   1151
HGLAVFQDEGAEPLKQRVEASISKASSFLGEKASAGLLGAHAAAITAYAL   1200 . . . 1201

TLTKAPADLRGVAHNNLMAMAQETGDNLYWGSVTGSQSNAVSPTPAPRNP   1250
|||||||||||||||||||||||||||||||||||||||||||||||||   1201
TLTKAPADLRGVAHNNLMAMAQETGDNLYWGSVTGSQSNAVSPTPAPRNP   1250 . . . 1251

SDPMPQAPALWIETTAYALLHLLLHEGKAEMADQAAAWLTRQGSFQGGFR   1300
|||||||||||||||||||||||||||||||||||||||||||||||||   1251
SDPMPQAPALWIETTAYALLHLLLHEGKAEMADQAAAWLTRQGSFQGGFR   1300 . . . 1301
```

```
STQDTVIALDALSAYWIASHTTEERGLNVTLSSTGRNGFKSHALQLNNRQ  1350
||||||||||||||||||||||||||||||||||||||||||||||||||  1301
STQDTVIALDALSAYWIASHTTEERGLNVTLSSTGRNGFKSHALQLNNRQ  1350 . . . 1351

IRGLEEELQFSLGSKINVKVGGNSKGTLKVLRTYNVLDMKNTTCQDLQIE  1400
||||||||||||||||||||||||||||||||||||||||||||||||||  1351
IRGLEEELQFSLGSKINVKVGGNSKGTLKVLRTYNVLDMKNTTCQDLQIE  1400 . . . 1401

VTVKGHVEYTMEANEDYEDYEYDELPAKDDPDAPLQPVTPLQLFEGRRNR  1450
||||||||||||||||||||||||||||||||||||||||||||||||||  1401
VTVKGHVEYTMEANEDYEDYEYDELPAKDDPDAPLQPVTPLQLFEGRRNR  1450 . . . 1451

RRREAPKVVEEQESRVHYTVCIWWAPGAALGQGREGRTQAGAGLLEPAQA  1500
|||||||||||||||||||||||                             1451
RRREAPKVVEEQESRVHYTVCIW. . . . . . . . . . . . . . . . . . . . . . . . . . 1473 . . . 1501

EPGRQLTRLHRRNGKVGLSGMAIADVTLLSGFHALRADLEKVWS        1544
           ||||||||||||||||||||||||||||||||        1474
. . . . . . . . . . . RNGKVGLSGMAIADVTLLSGFHALRADLEKLTS 1506
```

Description for Cluster HUMTREFAC

Cluster HUMTREFAC features 2 transcript(s) and 7 segment(s) of interest, the names for which are given in Tables 1 and 2, respectively, the sequences themselves are given at the end of the application. The selected protein variants are given in table 3. TABLE-US-00881 TABLE 1 Transcripts of interest Transcript Name Sequence ID No. HUMTREFAC_PEA_2_T4 507 HUMTREFAC_PEA_2_T5 508

TABLE-US-00882 TABLE 2 Segments of interest Segment Name Sequence ID No. HUMTREFAC_PEA_2_node_0 509 HUMTREFAC_PEA_2_node_9 510 HUMTREFAC_PEA_2_node_2 511 HUMTREFAC_PEA_2_node3 512 HUMTREFAC_PEA_2_node_4 513 HUMTREFAC_PEA_2_node_5 514 HUMTREFAC_PEA_2_node_8 515

TABLE-US-00883 TABLE 3 Proteins of interest Sequence Protein Name ID No. Corresponding Transcript(s) HUMTREFAC_PEA_2_P7 517 HUMTREFAC_PEA_2_T5 (SEQ ID NO: 508) HUMTREFAC_PEA_2_P8 518 HUMTREFAC_PEA_2_T4 (SEQ ID NO: 507)

These sequences are variants of the known protein Trefoil factor 3 precursor (SwissProt accession identifier TFF3_HUMAN; known also according to the synonyms Intestinal trefoil factor; hP1.B), SEQ ID NO: 516, referred to herein as the previously known protein.

Protein Trefoil factor 3 precursor (SEQ ID NO:516) is known or believed to have the following function(s): May have a role in promoting cell migration (motogen). The sequence for protein Trefoil factor 3 precursor is given at the end of the application, as "Trefoil factor 3 precursor amino acid sequence". Known polymorphisms for this sequence are as shown in Table 4. TABLE-US-00884 TABLE 4 Amino acid mutations for Known Protein SNP position(s) on amino acid sequence Comment 74-76 QEA→TRKT Protein Trefoil factor 3 precursor (SEQ ID NO:516) localization is believed to be Secreted.

The following GO Annotation(s) apply to the previously known protein. The following annotation(s) were found: defense response; digestion, which are annotation(s) related to Biological Process; and extracellular, which are annotation(s) related to Cellular Component.

The GO assignment relies on information from one or more of the SwissProt/TremBI Protein knowledgebase, available from expasy.ch/sprot/; or Locuslink, available from ncbi.nim.nih.gov/projects/LocusLink/.

Cluster HUMTREFAC can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 36 refer to weighted expression of ESTs in each category, as "parts per million" (ratio of the expression of ESTs for a particular cluster to the expression of all ESTs in that category, according to parts per million).

Figure 36:
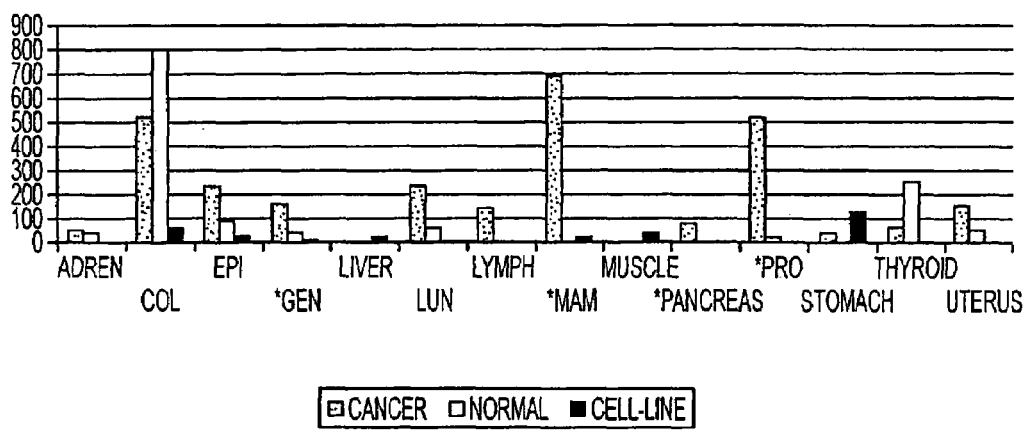
FIG. 36 is a histogram showing Cancer and cell-line vs. normal tissue expression for Cluster HUMTREFAC, demonstrating overexpression in a mixture of malignant tumors from different tissues, breast malignant tumors, pancreas carcinoma and prostate cancer.

Overall, the following results were obtained as shown with regard to the histograms in FIG. 36 and Table 5. This cluster is overexpressed (at least at a minimum level) in the following pathological conditions: a mixture of malignant tumors from different tissues, breast malignant tumors, pancreas carcinoma and prostate cancer. TABLE-US-00885 TABLE 5 Normal tissue distribution Name of Tissue Number adrenal 40 colon 797 epithelial 95 general 39 liver 0 lung 57 lymph nodes 3 breast 0 muscle 3 pancreas 2 prostate 16 stomach 0 Thyroid 257 uterus 54

TABLE-US-00886 TABLE 6 P values and ratios for expression in cancerous tissue Name of Tissue P1 P2 SP1 R3 SP2 R4 adrenal 6.4e-01 6.9e-01 7.1e-01 1.1 7.8e-01 0.9 colon 4.6e-01 5.7e-01 9.7e-01 0.5 1 0.4 epithelial 2.4e-02 3.4e-01 9.5e-10 2.0 5.3e-02 1.1 general 2.5e-04 3.9e-02 1.4e-28 3.6 1.9e-10 1.9 liver 1 6.8e-01 1 1.0 6.9e-01 1.4 lung 4.8e-01 7.6e-01 2.2e-03 1.0 1.6e-01 0.5 lymph nodes 5.1e-01 8.0e-01 2.3e-02 5.0 1.9e-01 2.1 breast 7.6e-02 1.2e-01 3.1e-06 12.0 1.1e-03 6.5 muscle 9.2e-01 4.8e-01 1 0.8 3.9e-01 2.1 pancreas 1.2e-01 2.4e-01 5.7e-03 6.5 2.1e-02 4.6 prostate 1.5e-01 2.7e-01 9.9e-10 8.1 3.1e-07 5.7 stomach 3.0e-01 1.3e-01 5.0e-01 2.0 6.7e-02 2.8 Thyroid 6.4e-01 6.4e-01 9.6e-01 0.5 9.6e-01 0.5 uterus 4.1e-01 7.3e-01 7.5e-02 1.3 4.0e-01 0.8

As noted above, cluster HUMTREFAC features 2 transcript(s), which were listed in Table 1 above. These transcript(s) encode for protein(s) which are variant(s) of protein Trefoil factor 3 precursor (SEQ ID NO:516). A description of each variant protein according to the present invention is now provided.

Variant protein HUMTREFAC_PEA.sub.--2_P7 (SEQ ID NO:517) according to the present invention has an amino acid sequence as given at the end of the application; it is encoded by transcript(s) HUMTREFAC_PEA.sub.--2_T5 (SEQ ID NO:508). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTREFAC_PEA.sub.--2_P7 (SEQ ID NO:517) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein HUMTREFAC_PEA.sub.--2_P7 (SEQ ID NO:517) sequence provides support for the deduced sequence of this variant protein according to the present invention). TABLE-US-00887 TABLE 7 Amino acid mutations SNP position(s) on amino acid Alternative sequence amino acid(s) Previously known SNP? 5 A→S No 5 A→T No 14 A→V Yes 43 L→M No 60 P→S Yes 123 S→*Yes Variant protein HUMTREFAC_PEA.sub.--2_P7 (SEQ ID NO:517) is encoded by the following transcript(s): HUMTREFAC_PEA.sub.--2_T5 (SEQ ID NO:508), for which the sequence(s) is/are given at the end of the application. The coding portion of transcript HUMTREFAC_PEA.sub.--2_T5 (SEQ ID NO:508) is shown in bold; this coding portion starts at position 278 and ends at position 688. The transcript also has the following SNPs as listed in Table 8 (given according to their position on the nucleotide sequence, with the alternative nucleic acid listed; the last column indicates whether the SNP is known or not; the presence of known SNPs in variant protein HUMTREFAC_PEA.sub.--2_P7 (SEQ ID NO:517) sequence provides support for the deduced sequence of this variant protein according to the present invention). TABLE-US-00888 TABLE 8 Nucleic acid SNPs SNP position on nucleotide Alternative sequence nucleic acid Previously known SNP? 233 A→G Yes 290 G→A No 290 G→T No 318 C→T Yes 404 C→A No 404 C→T No 455 C→T Yes 645 C→A Yes 685 C→T No Variant protein HUMTREFAC_PEA.sub.--2_P8 (SEQ ID NO:518) according to the present invention has an amino acid sequence as given at the end of the application; it is encoded by transcript(s) HUMTREFAC_PEA.sub.--2_T4 (SEQ ID NO:507). An alignment is given to the known protein (Trefoil factor 3 precursor (SEQ ID NO:516)) at the end of the application. One or more alignments to one or more previously published protein sequences are given at the end of the application. A brief description of the relationship of the variant protein according to the present invention to each such aligned protein is as follows:

Comparison report between HUMTREFAC_PEA.sub.--2_P8 (SEQ ID NO:518) and TFF3_HUMAN (SEQ ID NO:516):

1. An isolated chimeric polypeptide encoding for HUMTREFAC_PEA.sub.--2_P8 (SEQ ID NO:518), comprising a first amino acid sequence being at least 90% homologous to MAARALCMLGLVLALLSSSSAEEYVGL corresponding to amino acids 1-27 of TFF3_HUMAN (SEQ ID NO:516), which also corresponds to amino acids 1-27 of HUMTREFAC_PEA.sub.--2_P8 (SEQ ID NO:518), and a second amino acid sequence being at least 70%, optionally at least 80%, preferably at least 85%, more preferably at least 90% and most preferably at least 95% homologous to a polypeptide having the sequence WKVHLPKGEGFSSG (SEQ ID NO:996) corresponding to amino acids 28-41 of HUMTREFAC_PEA.sub.--2_P8 (SEQ ID NO:518), wherein said first amino acid sequence and second amino acid sequence are contiguous and in a sequential order.

2. An isolated polypeptide encoding for a tail of HUMTREFAC_PEA.sub.--2_P8 (SEQ ID NO:518), comprising a polypeptide being at least 70%, optionally at least about 80%, preferably at least about 85%, more preferably at least about 90% and most preferably at least about 95% homologous to the sequence WKVHLPKGEGFSSG (SEQ ID NO:996) in HUMTREFAC_PEA.sub.--2_P8 (SEQ ID NO:518).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTREFAC_PEA.sub.--2_P8 (SEQ ID NO:518) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein HUMTREFAC_PEA.sub.--2_P8 (SEQ ID NO:518) sequence provides support for the deduced sequence of this variant protein according to the present invention). TABLE-US-00889 TABLE 9 Amino acid mutations SNP position(s) on amino acid Alternative sequence amino acid(s) Previously known SNP? 5 A→S No 5 A→T No 14 A→V Yes Variant protein HUMTREFAC_PEA.sub.--2_P8 (SEQ ID NO:518) is encoded by the following transcript(s): HUMTREFAC_PEA.sub.--2_T4 (SEQ ID NO:507), for which the sequence(s) is/are given at the end of the application. The coding portion of transcript HUMTREFAC_PEA.sub.--2_T4 (SEQ ID NO:507) is shown in bold; this coding portion starts at position 278 and ends at position 400. The transcript also has the following SNPs as listed in Table 10 (given according to their position on the nucleotide sequence, with the alternative nucleic acid listed; the last column indicates whether the SNP is known or not; the presence of known SNPs in variant protein HUMTREFAC_PEA.sub.--2_P8 (SEQ ID NO:518) sequence provides support for the deduced sequence of this variant protein according to the present invention). TABLE-US-00890 TABLE 10 Nucleic acid SNPs SNP position on nucleotide Alternative sequence nucleic acid Previously known SNP? 233 A→G Yes 290 G→A No 290 G→T No 318 C→T Yes 515 C→A No 515 C→T No 566 C→T Yes 756 C→A Yes 796 C→T No 1265 A→C No 1266A→T No As noted above, cluster HUMTREFAC features 7 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMTREFAC_PEA.sub.--2_node.sub.--0 (SEQ ID NO:509) according to the present invention is supported by 188 libraries. The number of libraries was determined as previously described. This segment can be found in the following transcript(s): HUMTREFAC_PEA.sub.--2_T4 (SEQ ID NO:507) and HUMTREFAC_PEA.sub.--2_T5 (SEQ ID NO:508). Table 11 below describes the starting and ending position of this segment on each transcript. TABLE-US-00891 TABLE 11 Segment location on transcripts Segment Segment ending Transcript name starting position position HUMTREFAC_PEA__2_T4 (SEQ ID 1 359 NO: 507) HUMTREFAC_PEA__2_T5 (SEQ ID 1 359 NO: 508)

Segment cluster HUMTREFAC_PEA.sub.--2_node.sub.--9 (SEQ ID NO:510) according to the present invention is supported by 150 libraries. The number of libraries was determined as previously described. This segment can be found in the following transcript(s): HUMTREFAC_PEA.sub.--2_T4 (SEQ ID NO:507) and HUMTREFAC_PEA.sub.--2_T5 (SEQ ID NO:508). Table 12 below describes the starting and ending position of this segment on each transcript. TABLE-US-00892 TABLE 12 Segment location on transcripts Segment Segment ending Transcript name starting position position HUMTREFAC_PEA__2_T4 (SEQ ID 681 1266 NO: 507) HUMTREFAC_PEA__2_T5 (SEQ ID 570 747 NO: 508)

According to an optional embodiment of the present invention, short segments related to the above cluster are also provided. These segments are up to about 120 bp in length, and so are included in a separate description.

Segment cluster HUMTREFAC_PEA.sub.--2_node.sub.--2 (SEQ ID NO:511) according to the present invention is supported by 4 libraries. The number of libraries was determined as previously described. This segment can be found in the following transcript(s): HUMTREFAC_PEA.sub.--2_T4 (SEQ ID NO:507). Table 13 below describes the starting and ending position of this segment on each transcript. TABLE-US-00893 TABLE 13 Segment location on transcripts Segment Segment ending Transcript name starting position position HUMTREFAC_PEA__2_T4 (SEQ ID 360 470 NO: 507)

Segment cluster HUMTREFAC_PEA.sub.--2_node.sub.--3 (SEQ ID NO:512) according to the present invention is supported by 10 libraries. The number of libraries was determined as previously described. This segment can be found in the following transcript(s): HUMTREFAC_PEA.sub.--2_T4 (SEQ ID NO:507) and HUMTREFAC_PEA.sub.--2_T5 (SEQ ID NO:508). Table 14 below describes the starting and ending position of this segment on each transcript. TABLE-US-00894 TABLE 14 Segment location on transcripts Segment Segment ending Transcript name starting position position HUMTREFAC_PEA__2_T4 (SEQ ID 471 514 NO: 507) HUMTREFAC_PEA__2_T5 (SEQ ID 360 403 NO: 508)

Segment cluster HUMTREFAC_PEA.sub.--2_node.sub.--4 (SEQ ID NO:513) according to the present invention is supported by 197 libraries. The number of libraries was determined as previously described. This segment can be found in the following transcript(s): HUMTREFAC_PEA.sub.--2_T4 (SEQ ID NO:507) and HUMTREFAC_PEA.sub.--2_T5 (SEQ ID NO:508). Table 15 below describes the starting and ending position of this segment on each transcript. TABLE-US-00895 TABLE 15 Segment location on transcripts Segment Segment starting ending Transcript name position position HUMTREFAC_PEA__2_T4 (SEQ ID 515 611 NO: 507) HUMTREFAC_PEA__2_T5 (SEQ ID 404 500 NO: 508)

Segment cluster HUMTREFAC_PEA.sub.--2_node.sub.--5 (SEQ ID NO:514) according to the present invention is supported by 187 libraries. The number of libraries was determined as previously described. This segment can be found in the following transcript(s): HUMTREFAC_PEA.sub.--2_T4 (SEQ ID NO:507) and HUMTREFAC_PEA.sub.--2_T5 (SEQ ID NO:508). Table 16 below describes the starting and ending position of this segment on each transcript. TABLE-US-00896 TABLE 16 Segment location on transcripts Segment Segment starting ending Transcript name position position HUMTREFAC_PEA__2_T4 (SEQ ID 612 661 NO: 507) HUMTREFAC_PEA__2_T5 (SEQ ID 501 550 NO: 508)

Segment cluster HUMTREFAC_PEA.sub.--2_node.sub.--8 (SEQ ID NO:515) according to the present invention can be found in the following transcript(s): HUMTREFAC_PEA.sub.--2_T4 (SEQ ID NO:507) and HUMTREFAC_PEA.sub.--2_T5 (SEQ ID NO:508). Table 17 below describes the starting and ending position of this segment on each transcript. TABLE-US-00897 TABLE 17 Segment location on transcripts Segment Segment starting ending Transcript name position position HUMTREFAC_PEA__2_T4 (SEQ ID 662 680 NO: 507) HUMTREFAC_PEA__2_T5 (SEQ ID 551 569 NO: 508)

Variant protein alignment to the previously known protein:

Sequence name: TFF3_HUMAN (SEQ ID NO:516)

Sequence documentation:

Alignment of: HUMTREFAC_PEA.sub.--2_P8 (SEQ ID NO:518).times.TFF3_HUMAN (SEQ ID NO:516).

Alignment segment 1/1: TABLE-US-00898 Quality: 246.00 Escore: 0 Matching length: 27 Total length: 27 Matching Percent 100.00 Matching Percent Identity: 100.00 Similarity: Total Percent Similarity: 100.00 Total Percent Identity: 100.00 Gaps: 0

```
Alignment: TABLE-US-00899 . . . 1
MAARALCMLGLVLALLSSSSAEEYVGL              27
|||||||||||||||||||||||||||               1
MAARALCMLGLVLALLSSSSAEEYVGL              27
```

Description for Cluster HUMOSTRO

Cluster HUMOSTRO features 3 transcript(s) and 30 segment(s) of interest, the names for which are given in Tables 1 and 2, respectively, the sequences themselves are given at the end of the application. The selected protein variants are given in table 3. TABLE-US-00900 TABLE 1 Transcripts of interest Transcript Name Sequence ID No. HUMOSTRO_PEA__1_PEA__1_T14 519 HUMOSTRO_PEA__1_13_PEA__1_T16 520 HUMOSTRO_PEA__1_PEA__1_T30 521

TABLE-US-00901 TABLE 2 Segments of interest Segment Name Sequence ID No. HUMOSTRO_PEA__1_PEA__1_node__0 522 HUMOSTRO_PEA__1_PEA__1_node__10 523 HUMOSTRO_PEA__1_PEA__1_node__16 524 HUMOSTRO_PEA__1_PEA__1_node__23 525 HUMOSTRO_PEA__1_PEA__1_node__31 526 HUMOSTRO_PEA__1_PEA__1_node__43 527 HUMOSTRO_PEA__1_PEA__1_node__3 528 HUMOSTRO_PEA__1_PEA__1_node__5 529 HUMOSTRO_PEA__1_PEA__1_node__7 530 HUMOSTRO_PEA__1_PEA__1_node__8 531 HUMOSTRO_PEA__1_PEA__1_node__15 532 HUMOSTRO_PEA__1_PEA__1_node__17 533 HUMOSTRO_PEA__1_PEA__1_node__20 534 HUMOSTRO_PEA__1_PEA__1_node__21 535 HUMOSTRO_PEA__1_PEA__1_node__22 536 HUMOSTRO_PEA__1_PEA__1_node__24 537 HUMOSTRO_PEA__1_PEA__1_node__26 538 HUMOSTRO_PEA__1_PEA__1_node__27 539 HUMOSTRO_PEA__1_PEA__1_node__28 540 HUMOSTRO_PEA__1_PEA__1_node__29 541 HUMOSTRO_PEA__1_PEA__1_node__30 542 HUMOSTRO_PEA__1_PEA__1_node__32 543 HUMOSTRO_PEA__1_PEA__1_node__34 544 HUMOSTRO_PEA__1_PEA__1_node__36 545 HUMOSTRO_PEA__1_PEA__1_node__37 546 HUMOSTRO_PEA__1_PEA__1_node__38 547 HUMOSTRO_PEA__1_PEA__1_node__39 548 HUMOSTRO_PEA__

1_PEA_1_node_40 549 HUMOSTRO_PEA_1_PEA_1_node_41 550 HUMOSTRO_PEA_1_PEA_1_node_42 551

TABLE-US-00902 TABLE 3 Proteins of interest Sequence Corresponding Protein Name ID No. Transcript(s) HUMOSTRO_PEA_1_PEA_1_P21 553 HUMOSTRO_PEA_1_PEA_1_T14 (SEQ ID NO:519) HUMOSTRO_PEA_1_PEA_1_P25 554 HUMOSTRO_PEA_1_PEA_1_T16 (SEQ ID NO:520) HUMOSTRO_PEA_1_PEA_1_P30 555 HUMOSTRO_PEA_1_PEA_1_T30 (SEQ ID NO:521)

These sequences are variants of the known protein Osteopontin precursor (SwissProt accession identifier OSTP_ HUMAN; known also according to the synonyms Bone sialoprotein 1; Urinary stone protein; Secreted phosphoprotein 1; SPP-1; Nephropontin; Uropontin), SEQ ID NO: 552, referred to herein as the previously known protein.

Protein Osteopontin precursor (SEQ ID NO:552) is known or believed to have the following function(s): Binds tightly to hydroxyapatite. Appears to form an integral part of the mineralized matrix. Probably important to cell-matrix interaction; Acts as a cytokine involved in enhancing production of interferon-gamma and interleukin-12 and reducing production of interleukin-10 and is essential in the pathway that leads to type I immunity (By similarity). The sequence for protein Osteopontin precursor (SEQ ID NO:552) is given at the end of the application, as "Osteopontin precursor (SEQ ID NO:552) amino acid sequence". Known polymorphisms for this sequence are as shown in Table 4. TABLE-US-00903 TABLE 4 Amino acid mutations for Known Protein SNP position(s) on amino acid sequence Comment 301 R→H (in dbSNP: 4660). /FTId=VAR_014717. 188 D→H 237 T→A 275-278 SHEF→GNSL Protein Osteopontin precursor (SEQ ID NO:552) localization is believed to be Secreted.

The previously known protein also has the following indication(s) and/or potential therapeutic use(s): Regeneration, bone. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Bone formation stimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Musculoskeletal.

The following GO Annotation(s) apply to the previously known protein. The following annotation(s) were found: ossification; anti-apoptosis; inflammatory response; cell-matrix adhesion; cell-cell signaling, which are annotation(s) related to Biological Process; defense/immunity protein; cytokine; integrin ligand; protein binding; growth factor; apoptosis inhibitor, which are annotation(s) related to Molecular Function; and extracellular matrix, which are annotation(s) related to Cellular Component.

The GO assignment relies on information from one or more of the SwissProt/TremBl Protein knowledgebase, available from expasy.ch/sprot/; or Locuslink, available from ncbi.nlm.nih.gov/projects/LocusLink/.

Cluster HUMOSTRO can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 37 refer to weighted expression of ESTs in each category, as "parts per million" (ratio of the expression of ESTs for a particular cluster to the expression of all ESTs in that category, according to parts per million).

Figure 37:
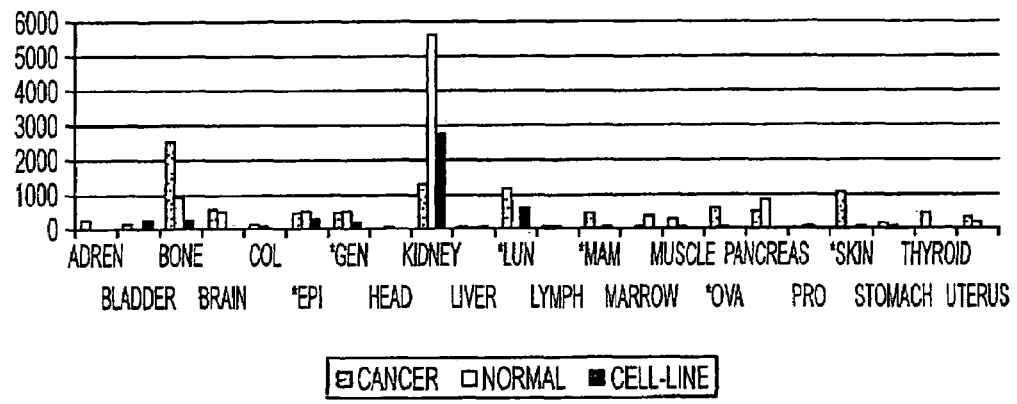
FIG. 37 is a histogram showing Cancer and cell-line vs. normal tissue expression for Cluster HUMOSTRO, demonstrating overexpression in epithelial malignant tumors, a mixture of malignant tumors from different tissues, lung malignant tumors, breast malignant tumors, ovarian carcinoma and skin malignancies.

Overall, the following results were obtained as shown with regard to the histograms in FIG. 37 and Table 5. This cluster is overexpressed (at least at a minimum level) in the following pathological conditions: epithelial malignant tumors, a mixture of malignant tumors from different tissues, lung malignant tumors, breast malignant tumors, ovarian carcinoma and skin malignancies. TABLE-US-00904 TABLE 5 Normal tissue distribution Name of Tissue Number adrenal 4 bladder 0 bone 897 brain 506 colon 69 epithelial 548 general 484 head and neck 50 kidney 5618 liver 4 lung 10 lymph nodes 75 breast 8 bone marrow 62 muscle 37 ovary 40 pancreas 845 prostate 48 skin 13 stomach 73 Thyroid 0 uterus 168

TABLE-US-00905 TABLE 6 P values and ratios for expression in cancerous tissue Name of Tissue P1 P2 SP1 R3 SP2 R4 adrenal 1.5e-01 2.1e-01 2.0e-02 4.6 4.4e-02 3.6 bladder 1.2e-01 9.2e-02 5.7e-02 4.1 2.1e-02 4.3 bone 4.9e-01 7.4e-01 4.1e-06 0.6 5.4e-01 0.4 brain 6.6e-01 7.0e-01 3.2e-01 0.6 1 0.4 colon 2.7e-01 4.0e-01 3.1e-01 1.5 5.2e-01 1.1 epithelial 2.0e-07 1.6e-03 9.8e-01 0.7 1 0.5 general 1.2e-06 1.2e-02 7.9e-01 0.8 1 0.6 head and neck 3.4e-01 5.0e-01 1 0.7 1 0.7 kidney 6.8e-01 7.4e-01 1 0.2 1 0.1 liver 3.3e-01 2.5e-01 1 1.8 2.3e-01 2.6 lung 4.3e-04 4.6e-03 2.1e-30 15.0 2.8e-27 23.5 lymph nodes 6.7e-01 8.7e-01 8.1e-01 0.7 9.9e-01 0.3 breast 2.3e-01 3.0e-01 1.9e-04 6.2 4.1e-03 4.3 bone marrow 7.5e-01 7.8e-01 1 0.3 2.0e-02 1.2 muscle 4.0e-02 7.5e-02 1.1e-01 4.6 5.1e-01 1.5 ovary 4.7e-02 8.4e-02 1.9e-05 5.4 8.3e-04 3.7 pancreas 5.0e-02 3.3e-01 1 0.3 1 0.2 prostate 8.5e-01 9.0e-01 8.9e-01 0.7 9.5e-01 0.6 skin 1.6e-01 1.6e-01 1.2e-10 12.6 5.2e-04 4.1 stomach 1.5e-01 6.3e-01 5.0e-01 1.2 9.4e-01 0.6 Thyroid 2.9e-01 2.9e-01 5.9e-02 2.0 5.9e-02 2.0 uterus 6.1e-02 5.7e-01 1.1e-01 1.3 7.0e-01 0.7

As noted above, cluster HUMOSTRO features 3 transcript(s), which were listed in Table 1 above. These transcript(s) encode for protein(s) which are variant(s) of protein Osteopontin precursor (SEQ ID NO:552). A description of each variant protein according to the present invention is now provided.

Variant protein HUMOSTRO_PEA.sub.--1_PEA.sub.--1_P21 (SEQ ID NO:553) according to the present invention has an amino acid sequence as given at the end of the application; it is encoded by transcript(s) HUMOSTRO_PEA.sub.--1_PEA.sub.--1_T14 (SEQ ID NO:519). An alignment is given to the known protein (Osteopontin precursor (SEQ ID NO:552)) at the end of the application. One or more alignments to one or more previously published protein sequences are given at the end of the application. A brief description of the relationship of the variant protein according to the present invention to each such aligned protein is as follows:

Comparison report between HUMOSTRO_PEA.sub.--1_PEA.sub.--1_P21 (SEQ ID NO:553) and OSTP_HUMAN (SEQ ID NO:552):

1. An isolated chimeric polypeptide encoding for HUMOSTRO_PEA.sub.--1_PEA.sub.--1_P21 (SEQ ID NO:553), comprising a first amino acid sequence being at least 90% homologous to MRIAVICFCLLGITCAIPVKQADSGSSEEKQLYNKYPDAVATWLNPDPSQKQNLLAPQ corresponding to amino acids 1-58 of OSTP_HUMAN (SEQ ID NO:552), which also corresponds to amino acids 1-58 of HUMOSTRO_PEA.sub.--1_PEA.sub.--1_P21 (SEQ ID NO:553), and a second amino acid sequence being at least 70%, optionally at least 80%, preferably at least 85%, more preferably at least 90% and most preferably at least 95% homologous to a polypeptide having the sequence VFLNFS (SEQ ID NO:997) corresponding to amino acids 59-64 of HUMOSTRO_PEA.sub.--1_PEA.sub.--1_P21 (SEQ ID NO:553), wherein said first amino acid sequence and second amino acid sequence are contiguous and in a sequential order.

2. An isolated polypeptide encoding for a tail of HUMOSTRO_PEA.sub.--1_PEA.sub.--1_P21 (SEQ ID NO:553), comprising a polypeptide being at least 70%, optionally at least about 80%, preferably at least about 85%, more preferably at least about 90% and most preferably at least about 95% homologous to the sequence VFLNFS (SEQ ID NO:997) in HUMOSTRO_PEA.sub.--1_PEA.sub.--1_P21 (SEQ ID NO:553).

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMOSTRO_PEA.sub.--1_PEA.sub.--1_P21 (SEQ ID NO:553) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein HUMOSTRO_PEA.sub.--1_PEA.sub.--1_P21 (SEQ ID NO:553) sequence provides support for the deduced sequence of this variant protein according to the present invention). TABLE-US-00906 TABLE 7 Amino acid mutations SNP position(s) on Alternative Previously amino acid sequence amino acid(s) known SNP? 7 C→W No 31 Q→R No 47 D→V Yes 49 S→P No The glycosylation sites of variant protein HUMOSTRO_PEA.sub.--1_PEA.sub.--1_P21 (SEQ ID NO:553), as compared to the known protein Osteopontin precursor (SEQ ID NO:552), are described in Table 8 (given according to their position(s) on the amino acid sequence in the first column; the second column indicates whether the glycosylation site is present in the variant protein; and the last column indicates whether the position is different on the variant protein). TABLE-US-00907 TABLE 8 Glycosylation site(s) Position(s) on known Present in Position in amino acid sequence variant protein? variant protein? 79 no 106 no Variant protein HUMOSTRO_PEA.sub.--1_PEA.sub.--1_P21 (SEQ ID NO:553) is encoded by the following transcript(s): HUMOSTRO_PEA.sub.--1_PEA.sub.--1_T14 (SEQ ID NO:519), for which the sequence(s) is/are given at the end of the application. The coding portion of transcript HUMOSTRO_PEA.sub.--1_PEA.sub.--1_T14 (SEQ ID NO:519) is shown in bold; this coding portion starts at position 199 and ends at position 390. The transcript also has the following SNPs as listed in Table 9 (given according to their position on the nucleotide sequence, with the alternative nucleic acid listed; the last column indicates whether the SNP is known or not; the presence of known SNPs in variant protein HUMOSTRO_PEA.sub.--1_PEA.sub.--1_P21 (SEQ ID NO:553) sequence provides support for the deduced sequence of this variant protein according to the present invention). TABLE-US-00908 TABLE 9 Nucleic acid SNPs SNP position on Alternative Previously nucleotide sequence nucleic acid known SNP? 136 A→G Yes 154 T→No 159 G→T Yes 219 C→G No 274→G No 290 A→G Yes 338→T Yes 343 T→C No 413 G→C Yes 707 C→T Yes 708 C→A Yes 715 A→G Yes 730 A→C No 730 A→G No 746 T→C Yes 767 C→T No 779 G→A Yes 866→G No 869 T→No 889→A No 891 A→C No 891 A→G No 905 T→C No 910→G No 910→T No 997A→G No 1026 G→C No 1042→G No 1042→T No 1071 A→No 1071 A→C No 1098A→No 1105 C→T No 1124→G No 1135 G→A Yes 1136 T→No 1136 T→G No 1173 A→C No 1173 A→G No 1179A→G No 1214C→T Yes 1246T→No 1246T→A No 1359A→No 1359A→G No 1362 T→No 1365 C→T Yes 1366 G→A Yes 1408 A→C No 1418 A→C No 1433 A→C No 1456 A→C No 1524 T→A No 1524 T→C No 1547 A→G Yes 1553 T→No 1574→G No 1654 A→C Yes 1691 A→G No 1703 A→C Yes 1755A→C No 1764T→No Variant protein HUMOSTRO_PEA.sub.--1_PEA.sub.--1_P25 (SEQ ID NO:554) according to the present invention has an amino acid sequence as given at the end of the application; it is encoded by transcript(s) HUMOSTRO_PEA.sub.--1_PEA.sub.--1_T16 (SEQ ID NO:520). An alignment is given to the known protein (Osteopontin precursor (SEQ ID NO:552) ) at the end of the application. One or more alignments to one or more previously published protein sequences are given at the end of the application. A brief description of the relationship of the variant protein according to the present invention to each such aligned protein is as follows:

Comparison report between HUMOSTRO_PEA.sub.--1_PEA.sub.--1_P25 (SEQ ID NO:554) and OSTP_HUMAN (SEQ ID NO:552):

1. An isolated chimeric polypeptide encoding for HUMOSTRO_PEA.sub.--1_PEA.sub.--1_P25 (SEQ ID NO:554), comprising a first amino acid sequence being at least 90% homologous to MRIAVICFCLLGITCAIPVKQADSGS-SEEKQ corresponding to amino acids 1-31 of OSTP_HUMAN (SEQ ID NO:552), which also corresponds to amino acids 1-31 of HUMOSTRO_PEA.sub.--1_PEA.sub.--1_P25 (SEQ ID NO:554), and a second amino acid sequence being at least 70%, optionally at least 80%, preferably at least 85%, more preferably at least 90% and most preferably at least 95% homologous to a polypeptide having the sequence H corresponding to amino acids 32-32 of HUMOSTRO_PEA.sub.--1_PEA.sub.--1_P25 (SEQ ID NO:554), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMOSTRO_PEA.sub.--1_PEA.sub.--1_P25 (SEQ ID NO:554) also has the following non-silent SNPs (Single Nucleotide Polymorphisms) as listed in Table 10, (given according to their position(s) on the amino acid sequence, with the alternative amino acid(s) listed; the last column indicates whether the SNP is known or not; the presence of known SNPs in variant protein HUMOSTRO_PEA.sub.--1_PEA.sub.--1_P25 (SEQ ID NO:554) sequence provides support for the deduced sequence of this variant protein according to the present invention). TABLE-US-00909 TABLE 10 Amino acid mutations SNP position(s) on amino acid Alternative sequence amino acid(s) Previously known SNP? 7 C→W No 31 Q→R No The glycosylation sites of variant protein HUMOSTRO_PEA.sub.--1_PEA.sub.--1_P25 (SEQ ID NO:554), as compared to the known protein Osteopontin precursor (SEQ ID NO:552), are described in Table 11 (given according to their position(s) on the amino acid sequence in the first column; the second column indicates whether the glycosylation site is present in the variant protein; and the last column indicates whether the position is different on the variant protein). TABLE-US-00910 TABLE 11 Glycosylation site(s) Position(s) on known Present in Position amino acid sequence variant protein? in variant protein? 79 no 106 no Variant protein HUMOSTRO_PEA.sub.--1_PEA.sub.--1_P25 (SEQ ID NO:554) is encoded by the following transcript(s): HUMOSTRO_PEA.sub.--1_PEA.sub.--1_T16 (SEQ ID NO:520), for which the sequence(s) is/are given at the end of the application. The coding portion of transcript HUMOSTRO_PEA.sub.--1_PEA.sub.--1_T16 (SEQ ID NO:520) is shown in bold; this coding portion starts at position 199 and ends at position 294. The transcript also has the following SNPs as listed in Table 12 (given according to their position on the nucleotide sequence, with the alternative nucleic acid listed; the last column indicates whether the SNP is known or not; the presence of known SNPs in variant protein HUMOSTRO_PEA.sub.--1_PEA.sub.--1_P25 (SEQ ID NO:554) sequence provides support for the deduced sequence of this variant protein according to the present invention). TABLE-US-00911 TABLE 12 Nucleic acid SNPs SNP position on Alternative Previously nucleotide sequence nucleic acid known SNP? 136 A→G Yes 154 T→No 159 G→T Yes 219 C→G No 274→G No 290A→G No 419 C→T Yes 454 G→C Yes 527 A→T Yes 532 T→C No 630 C→T Yes 631 C→A Yes 638 A→G Yes 653 A→C No 653 A→G No 669 T→C Yes 690 C→T No 702 G→A Yes 789→G No 792 T→No 812→A No 814 A→C No 814 A→G No 828 T→C No 833→G No 833→T No 920 A→G No 949 G→C No 965→G No 965→T No 994 A→No 994 A→C No 1021 A→No 1028 C→T No 1047→G No 1058 G→A Yes 1059T→No 1059T→G No 1096A→C No 1096 A→G No 1102 A→G No 1137 C→T Yes 1169 T→No 1169 T→A No 1282 A→No 1282A→G No 1285 T→No 1288 C→T Yes 1289 G→A Yes 1331 A→C No 1341 A→C No 1356 A→C No 1379 A→C No 1447 T→A No 1447 T→C No 1470 A→G Yes 1476 T→No 1497→G No 1577A→C Yes 1614A→G No 1626A→C Yes 1678A→C No 1687 T→No Variant protein HUMOSTRO_PEA.sub.--1_PEA.sub.--1_P30 (SEQ ID NO:555) according to the present invention has an amino acid sequence as given at the end of the application; it is encoded by transcript(s) HUMOSTRO_PEA.sub.--1_PEA.sub.--1_T30 (SEQ ID NO:521). An alignment is given to the known protein (Osteopontin precursor (SEQ ID NO:552) ) at the end of the application. One or more alignments to one or more previously published protein sequences are given at the end of the application. A brief description of the relationship of the variant protein according to the present invention to each such aligned protein is as follows:

Comparison report between HUMOSTRO_PEA.sub.--1_PEA.sub.--1_P30 (SEQ ID NO:555) and OSTP_HUMAN (SEQ ID NO:552):

1. An isolated chimeric polypeptide encoding for HUMOSTRO_PEA.sub.--1_PEA.sub.--1_P30 (SEQ ID NO:555), comprising a first amino acid sequence being at least 90% homologous to MRIAVICFCLLGITCAIPVKQADSGSSEEKQ corresponding to amino acids 1-31 of OSTP_HUMAN (SEQ ID NO:552), which also corresponds to amino acids 1-31 of HYMOSTRO_PEA.sub.--1_PEA.sub.--1_P30 (SEQ ID NO:555), and a second amino acid sequence being at least 70%, optionally at least 80%, preferably at least 85%, more preferably at least 90% and most preferably at least 95% homologous to a polypeptide having the sequence VSIFYVFI (SEQ ID NO:998) corresponding to amino acids 32-39 of HUMOSTRO_PEA.sub.--1_PEA.sub.--1_P30 (SEQ ID NO:555), wherein said first amino acid sequence and second amino acid sequence are contiguous and in a sequential order.

2. An isolated polypeptide encoding for a tail of HUMOSTRO_PEA.sub.--1_PEA.sub.--1_P30 (SEQ ID NO:555), comprising a polypeptide being at least 70%, optionally at least about 80%, preferably at least about 85%, more preferably at least about 90% and most preferably at least about 95% homologous to the sequence VSIFYVFI (SEQ ID NO:998) in HUMOSTRO_PEA.sub.--1_PEA.sub.--1_P30 (SEQ ID NO:555).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMOSTRO_PEA.sub.--1_PEA.sub.--1_P30 (SEQ ID NO:555) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein HUMOSTRO_PEA.sub.--1_PEA.sub.--1_P30 (SEQ ID NO:555) sequence provides support for the deduced sequence of this variant protein according to the present invention). TABLE-US-00912 TABLE 13 Amino acid mutations SNP position(s) on amino acid Alternative sequence amino acid(s) Previously known SNP? 7 C→W No 31 Q→R No The glycosylation sites of variant protein HUMOSTRO_PEA.sub.--1_PEA.sub.--1_P30 (SEQ ID NO:555), as compared to the known protein Osteopontin precursor (SEQ ID NO:552), are described in Table 14 (given according to their position(s) on the amino acid sequence in the first column; the second column indicates whether the glycosylation site is present in the variant protein; and the last column indicates whether the position is different on the variant protein). TABLE-US-00913 TABLE 14 Glycosylation site(s) Position(s) on known amino acid sequence Present in variant protein? 79 no 106 no Variant protein HUMOSTRO_PEA.sub.--1_PEA.sub.--1_P30 (SEQ ID NO:555) is encoded by the following transcript(s): HUMOSTRO_PEA.sub.--1_PEA.sub.--1_T30 (SEQ ID NO:521), for which the sequence(s) is/are given at the end of the application. The coding portion of transcript HUMOSTRO_PEA.sub.--1_PEA.sub.--1_T30 (SEQ ID NO:521) is shown in bold; this coding portion starts at position 199 and ends at position 315. The transcript also has the following SNPs as listed in Table 15 (given according to their position on the nucleotide sequence, with the alternative nucleic acid listed; the last column indicates whether the SNP is known or not; the presence of known SNPs in variant protein HUMOSTRO_PEA.sub.--1_PEA.sub.--1_P30 (SEQ ID NO:555) sequence provides support for the deduced sequence of this variant protein according to the present invention). TABLE-US-00914 TABLE 15 Nucleic acid SNPs SNP position on Alternative Previously nucleotide sequence nucleic acid known SNP? 136A→G Yes 154T→No 159 G→T Yes 219 C→G No 274→G No290A→G No As noted above, cluster HUMOSTRO features 30 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMOSTRO_PEA.sub.--1_PEA.sub.--1_node.sub.--0 (SEQ ID NO:522) according to the present invention is supported by 333 libraries. The number of libraries was determined as previously described. This segment can be found in the following transcript(s): HUMOSTRO_PEA.sub.--1_PEA.sub.--1_T14 (SEQ ID NO:519), HUMOSTRO_ PEA.sub.--1_PEA.sub.--1.sub.T16 (SEQ ID NO:520) and HUMOSTRO_PEA.sub.--1_PEA.sub.--1_T30 (SEQ ID NO:521). Table 16 below describes the starting and ending position of this segment on each transcript. TABLE-US-00915 TABLE 16 Segment location on transcripts Segment Segment starting ending Transcript name position position HUMOSTRO_PEA_1_PEA_1_T14 1 184 (SEQ ID NO:519) HUMOSTRO_PEA_1_PEA_1_T16 1 184 (SEQ ID NO:520) HUMOSTRO_PEA_1_PEA_1_T30 1 184 (SEQ ID NO:521)

Segment cluster HUMOSTRO_PEA.sub.--1_PEA.sub.--1_node.sub.--10 (SEQ ID NO:523) according to the present invention is supported by 4 libraries. The number of libraries was determined as previously described. This segment can be found in the following transcript(s): HUMOSTRO_PEA.sub.--1_PEA.sub.--1_T16 (SEQ ID NO:520). Table 17 below describes the starting and ending position of this segment on each transcript. TABLE-US-00916 TABLE 17 Segment location on transcripts Segment Segment starting ending Transcript name position position HUMOSTRO_PEA_1_PEA_1_T16 292 480 (SEQ ID NO: 520)

Segment cluster HUMOSTRO_PEA.sub.--1_PEA.sub.--1_node.sub.--16 (SEQ ID NO:524) according to the present invention is supported by 6 libraries. The number of libraries was determined as previously described. This segment can be found in the following transcript(s): HUMOSTRO_PEA.sub.--1_PEA.sub.--1_T14 (SEQ ID NO:519). Table 18 below describes the starting and ending position of this segment on each transcript. TABLE-US-00917 TABLE 18 Segment location on transcripts Segment Segment starting ending Transcript name position position HUMOSTRO_PEA_1_PEA_1_T14 373 638 (SEQ ID NO:519)

Segment cluster HUMOSTRO_PEA.sub.--1_PEA.sub.--1_node.sub.--23 (SEQ ID NO:525) according to the present invention is supported by 334 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 19 below describes the starting and ending position of this segment on each transcript. TABLE-US-00918 TABLE 19 Segment location on transcripts Segment Segment starting ending Transcript name position position HUMOSTRO_PEA_1_PEA_1_T14 804 967 (SEQ ID NO:519) HUMOSTRO_PEA_1_PEA_1_T16 727 890 (SEQ ID NO:520)

Segment cluster HUMOSTRO_PEA.sub.--1_PEA.sub.--1_node.sub.--31 (SEQ ID NO:526) according to the present invention is supported by 350 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 20 below describes the starting and ending position of this segment on each transcript. TABLE-US-00919 TABLE 20 Segment location on transcripts Segment Segment starting ending Transcript name position position HUMOSTRO_PEA_1_PEA_1_T14 1164 1393 (SEQ ID NO:519) HUMOSTRO_PEA_1_PEA_1_T16 1087 1316 (SEQ ID NO:520)

Segment cluster HUMOSTRO_PEA.sub.--1_PEA.sub.--1_node.sub.--43 (SEQ ID NO:527) according to the present invention is supported by 192 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 21 below describes the starting and ending position of this segment on each transcript. TABLE-US-00920 TABLE 21 Segment location on transcripts Segment Segment starting ending Transcript name position position HUMOSTRO_PEA_1_PEA_1_T14 1810 1846 (SEQ ID NO:519) HUMOSTRO_PEA_1_PEA_1_T16 1733 1769 (SEQ ID NO:520)

According to an optional embodiment of the present invention, short segments related to the above cluster are also provided. These segments are up to about 120 bp in length, and so are included in a separate description.

Segment cluster HUMOSTRO_PEA.sub.--1_PEA.sub.--1_node.sub.--3 (SEQ ID NO:528) according to the present invention is supported by 353 libraries. The number of libraries was determined as previously described. This segment can be found in the following transcript(s): HUMOSTRO_PEA.sub.--1_PEA.sub.--1_T14(SEQ ID NO:519), HUMOSTRO_PEA.sub.--1_PEA.sub.--1_T16 (SEQ ID NO:520) and HUMOSTRO_PEA.sub.--1_PEA.sub.--1_T30 (SEQ ID NO:521). Table 22 below describes the starting and ending position of this segment on each transcript. TABLE-US-00921 TABLE 22 Segment location on transcripts Segment Segment starting ending Transcript name position position HUMOSTRO_PEA_1_PEA_1_T14 185 210 (SEQ ID NO:519) HUMOSTRO_PEA_1_PEA_1_T16 185 210 (SEQ ID NO:520) HUMOSTRO_PEA_1_PEA_1_T30 185 210 (SEQ ID NO:521)

Segment cluster HUMOSTRO_PEA.sub.--1_PEA.sub.--1_node.sub.--5 (SEQ ID NO:529) according to the present invention is supported by 353 libraries. The number of libraries was determined as previously described. This segment can be found in the following transcript(s): HUMOSTRO_PEA.sub.--1_PEA.sub.--1_T14 (SEQ ID NO:519), HUMOSTRO_ PEA.sub.--1_PEA.sub.--1_T16 (SEQ ID NO:520) and HUMOSTRO_PEA.sub.--1_PEA.sub.--1_T30 (SEQ ID NO:521). Table 23 below describes the starting and ending position of this segment on each transcript. TABLE-US-00922 TABLE 23 Segment location on transcripts Segment Segment starting ending Transcript name position position HUMOSTRO_PEA_1_PEA_1_T14 211 252 (SEQ ID NO:519) HUMOSTRO_PEA_1_PEA_1_T16 211 252 (SEQ ID NO:520) HUMOSTRO_PEA_1_PEA_1_T30 211 252 (SEQ ID NO:521)

Segment cluster HUMOSTRO_PEA.sub.--1_PEA.sub.--1_node.sub.--7 (SEQ ID NO:530) according to the present invention is supported by 357 libraries. The number of libraries was determined as previously described. This segment can be found in the following transcript(s): HUMOSTRO_PEA.sub.--1_PEA.sub.--1_T14 (SEQ ID NO:519), HUMOSTRO_ PEA.sub.--1_PEA.sub.--1_T16 (SEQ ID NO:520) and HUMOSTRO_PEA.sub.--1_PEA.sub.--1_T30 (SEQ ID NO:521). Table 24 below describes the starting and ending position of this segment on each transcript. TABLE-US-00923 TABLE 24 Segment location on transcripts Segment Segment starting ending Transcript name position position HUMOSTRO_PEA_1_PEA_1_T14 253 291 (SEQ ID NO:519) HUMOSTRO_PEA_1_PEA_1_T16 253 291 (SEQ ID NO:520) HUMOSTRO_PEA_1_PEA_1_T30 253 291 (SEQ ID NO:521)

Segment cluster HUMOSTRO_PEA.sub.--1_PEA.sub.--1_node.sub.--8 (SEQ ID NO:531) according to the present invention is supported by 1 libraries. The number of libraries was determined as previously described. This segment can be found in the following transcript(s): HUMOSTRO_PEA.sub.--1_PEA.sub.--1_T30 (SEQ ID NO:521). Table 25 below describes the starting and ending position of this segment on each transcript. TABLE-US-00924 TABLE 25 Segment location on transcripts Segment Segment starting ending Transcript name position position HUMOSTRO_PEA_1_PEA_1_T30 292 378 (SEQ ID NO:521)

Segment cluster HUMOSTRO_PEA.sub.--1_PEA.sub.--1_node.sub.--15 (SEQ ID NO:532) according to the present invention is supported by 366 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 26 below describes the starting and ending position of this segment on each transcript. TABLE-US-00925 TABLE 26 Segment location on transcripts Segment Segment starting ending Transcript name position position HUMOSTRO_PEA_1_PEA_1_T14 292 372 (SEQ ID NO:519) HUMOSTRO_PEA_1_PEA_1_T16 481 561 (SEQ ID NO:520)

Segment cluster HUMOSTRO_PEA.sub.--1_PEA.sub.--1_node.sub.--17 (SEQ ID NO:533) according to the present invention is supported by 261 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 27 below describes the starting and ending position of this segment on each transcript. TABLE-US-00926 TABLE 27 Segment location on transcripts Segment Segment starting ending Transcript name position position HUMOSTRO_PEA_1_PEA_1_T14 639 680 (SEQ ID NO:519) HUMOSTRO_PEA_1_PEA_1_T16 562 603 (SEQ ID NO:520)

Segment cluster HUMOSTRO_PEA.sub.--1_PEA.sub.--1_node.sub.--20 (SEQ ID NO:534) according to the present invention can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 28 below describes the starting and ending position of this segment on each transcript. TABLE-US-00927 TABLE 28 Segment location on transcripts Segment Segment starting ending Transcript name position position HUMOSTRO_PEA_1_PEA_1_T14 681 688 (SEQ ID NO:519) HUMOSTRO_PEA_1_PEA_1_T16 604 611 (SEQ ID NO:520)

Segment cluster HUMOSTRO_PEA.sub.--1_PEA.sub.--1_node.sub.--21 (SEQ ID NO:535) according to the present invention is supported by 315 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 29 below describes the starting and ending position of this segment on each transcript. TABLE-US-00928 TABLE 29 Segment location on transcripts Segment Segment starting ending Transcript name position position HUMOSTRO_PEA_1_PEA_1_T14 689 738 (SEQ ID NO:519) HUMOSTRO_PEA_1_PEA_1_T16 612 661 (SEQ ID NO:520)

Segment cluster HUMOSTRO_PEA.sub.--1_PEA.sub.--1_node.sub.--22 (SEQ ID NO:536) according to the present invention is supported by 322 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 30 below describes the starting and ending position of this segment on each transcript. TABLE-US-00929 TABLE 30 Segment location on transcripts Segment Segment starting ending Transcript name position position HUMOSTRO_PEA_1_PEA_1_T14 739 803 (SEQ ID NO:519) HUMOSTRO_PEA_1_PEA_1_T16 662 726 (SEQ ID NO:520)

Segment cluster HUMOSTRO_PEA.sub.--1_PEA.sub.--1_node.sub.--24 (SEQ ID NO:537) according to the present invention is supported by 270 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 31 below describes the starting and ending position of this segment on each transcript. TABLE-US-00930 TABLE 31 Segment location on transcripts Segment Segment starting ending Transcript name position position HUMOSTRO_PEA_1_PEA_1_T14 968 1004 (SEQ ID NO:519) HUMOSTRO_PEA_1_PEA_1_T16 891 927 (SEQ ID NO:520)

Segment cluster HUMOSTRO_PEA.sub.--1_PEA.sub.--1_node.sub.--26 (SEQ ID NO:538) according to the present invention can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 32 below describes the starting and ending position of this segment on each transcript. TABLE-US-00931 TABLE 32 Segment location on transcripts Segment Segment starting ending Transcript name position position HUMOSTRO_PEA_1_PEA_1_T14 1005 1022 (SEQ ID NO:519) HUMOSTRO_PEA_1_PEA_1_T16 928 945 (SEQ ID NO:520)

Segment cluster HUMOSTRO_PEA.sub.--1_PEA.sub.--1_node.sub.--27 (SEQ ID NO:539) according to the present invention is supported by 260 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 33 below describes the starting and ending position of this segment on each transcript. TABLE-US-00932 TABLE 33 Segment location on transcripts Segment Segment starting ending Transcript name position position HUMOSTRO_PEA_1_PEA_1_T14 1023 1048 (SEQ ID NO:519) HUMOSTRO_PEA_1_PEA_1_T16 946 971 (SEQ ID NO:520)

Segment cluster HUMOSTRO_PEA.sub.--1_PEA.sub.--1_node.sub.--28 (SEQ ID NO:540) according to the present invention is supported by 273 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 34 below describes the starting and ending position of this segment on each transcript. TABLE-US-00933 TABLE 34 Segment location on transcripts Segment Segment starting ending Transcript name position position HUMOSTRO_PEA_1_PEA_1_T14 1049 1100 (SEQ ID NO:519) HUMOSTRO_PEA_1_PEA_1_T16 972 1023 (SEQ ID NO:520)

Segment cluster HUMOSTRO_PEA.sub.--1_PEA.sub.--1_node.sub.--29 (SEQ ID NO:541) according to the present invention is supported by 272 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 35 below describes the starting and ending position of this segment on each transcript. TABLE-US-00934 TABLE 35 Segment location on transcripts Segment Segment starting ending Transcript name position position HUMOSTRO_PEA__1_PEA__1_T14 1101 1151 (SEQ ID NO:519) HUMOSTRO_PEA__1_PEA__1_T16 1024 1074 (SEQ ID NO:520)

Segment cluster HUMOSTRO_PEA.sub.--1_PEA.sub.--1_node.sub.--30 (SEQ ID NO:542) according to the present invention can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 36 below describes the starting and ending position of this segment on each transcript. TABLE-US-00935 TABLE 36 Segment location on transcripts Segment Segment starting ending Transcript name position position HUMOSTRO_PEA__1_PEA__1_T14 1152 1163 (SEQ ID NO:519) HUMOSTRO_PEA__1_PEA__1_T16 1075 1086 (SEQ ID NO:520)

Segment cluster HUMOSTRO_PEA.sub.--1_PEA.sub.--1_node.sub.--32 (SEQ ID NO:543) according to the present invention is supported by 293 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 37 below describes the starting and ending position of this segment on each transcript. TABLE-US-00936 TABLE 37 Segment location on transcripts Segment Segment starting ending Transcript name position position HUMOSTRO_PEA__1_PEA__1_T14 1394 1427 (SEQ ID NO:519) HUMOSTRO_PEA__1_PEA__1_T16 1317 1350 (SEQ ID NO:520)

Segment cluster HUMOSTRO_PEA.sub.--1_PEA.sub.--1_node.sub.--34 (SEQ ID NO:544) according to the present invention is supported by 301 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 38 below describes the starting and ending position of this segment on each transcript. TABLE-US-00937 TABLE 38 Segment location on transcripts Segment Segment starting ending Transcript name position position HUMOSTRO_PEA__1_PEA__1_T14 1428 1468 (SEQ ID NO:519) HUMOSTRO_PEA__1_PEA__1_T16 1351 1391 (SEQ ID NO:520)

Segment cluster HUMOSTRO_PEA.sub.--1_PEA.sub.--1_node.sub.--36 (SEQ ID NO:545) according to the present invention is supported by 292 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 39 below describes the starting and ending position of this segment on each transcript. TABLE-US-00938 TABLE 39 Segment location on transcripts Segment Segment starting ending Transcript name position position HUMOSTRO_PEA__1_PEA__1_T14 1469 1504 (SEQ ID NO:519) HUMOSTRO_PEA__1_PEA__1_T16 1392 1427 (SEQ ID NO:520)

Segment cluster HUMOSTRO_PEA.sub.--1_PEA.sub.--1_node.sub.--37 (SEQ ID NO:546) according to the present invention is supported by 295 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 40 below describes the starting and ending position of this segment on each transcript. TABLE-US-00939 TABLE 40 Segment location on transcripts Segment Segment starting ending Transcript name position position HUMOSTRO_PEA__1_PEA__1_T14 1505 1623 (SEQ ID NO 519) HUMOSTRO_PEA__1_PEA__1_T16 1428 1546 (SEQ ID NO:520)

Segment cluster HUMOSTRO_PEA.sub.--1_PEA.sub.--1_node.sub.--38 (SEQ ID NO:547) according to the present invention can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 41 below describes the starting and ending position of this segment on each transcript. TABLE-US-00940 TABLE 41 Segment location on transcripts Segment Segment starting ending Transcript name position position HUMOSTRO_PEA__1_PEA__1_T14 1624 1634 (SEQ ID NO:519) HUMOSTRO_PEA__1_PEA__1_T16 1547 1557 (SEQ ID NO:520)

Segment cluster HUMOSTRO_PEA.sub.--1_PEA.sub.--1_node.sub.--39 (SEQ ID NO:548) according to the present invention is supported by 268 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 42 below describes the starting and ending position of this segment on each transcript. TABLE-US-00941 TABLE 42 Segment location on transcripts Segment Segment starting ending Transcript name position position HUMOSTRO_PEA__1_PEA__1_T14 1635 1725 (SEQ ID NO:519) HUMOSTRO_PEA__1_PEA__1_T16 1558 1648 (SEQ ID NO:520)

Segment cluster HUMOSTRO_PEA.sub.--1_PEA.sub.--1_node.sub.--40 (SEQ ID NO:549) according to the present invention can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 43 below describes the starting and ending position of this segment on each transcript. TABLE-US-00942 TABLE 43 Segment location on transcripts Segment Segment starting ending Transcript name position position HUMOSTRO_PEA__1_PEA__1_T14 1726 1743 (SEQ ID NO:519) HUMOSTRO_PEA__1_PEA__1_T16 1649 1666 (SEQ ID NO:520)

Segment cluster HUMOSTRO_PEA.sub.--1_PEA.sub.--1_node.sub.--41 (SEQ ID NO:550) according to the present invention can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 44 below describes the starting and ending position of this segment on each transcript. TABLE-US-00943 TABLE 44 Segment location on transcripts Segment Segment starting ending Transcript name position position HUMOSTRO_PEA__1_PEA__1_T14 1744 1749 (SEQ ID NO:519) HUMOSTRO_PEA__1_PEA__1_T16 1667 1672 (SEQ ID NO:520)

Segment cluster HUMOSTRO_PEA.sub.--1_PEA.sub.--1_node.sub.--42 (SEQ ID NO:551) according to the present invention is supported by 224 libraries. The number of libraries was determined as previously described. This segment can be found in the following transcript(s): HUMOSTRO_PEA.sub.--1_PEA.sub.--1_T14 (SEQ ID NO:519) and HUMOSTRO_PEA.sub.--1_PEA.sub.--1_T16 (SEQ ID NO:520). Table 45 below describes the starting and ending position of this segment on each transcript. TABLE-US-00944 TABLE 45 Segment location on transcripts Segment Segment starting ending Transcript name position position HUMOSTRO_PEA_1_PEA_1_T14 1750 1809 (SEQ ID NO:519) HUMOSTRO_PEA_1_PEA_1_T16 1673 1732 (SEQ ID NO:520)

Variant protein alignment to the previously known protein:

Sequence name: OSTP_HUMAN (SEQ ID NO:552)

Sequence documentation:

Alignment of: HUMOSTRO_PEA.sub.--1_PEA.sub.--1_P21 (SEQ ID NO:553).times.OSTP HUMAN (SEQ ID NO:552).

Alignment segment 1/1: TABLE-US-00945 Quality: 578.00 Escore: 0 Matching length: 58 Total length: 58 Matching Percent 100.00 Matching Percent Identity: 100.00 Similarity: Total Percent Similarity: 100.00 Total Percent Identity: 100.00 Gaps: 0

```
Alignment: TABLE-US-00946 . . . 1
MRIAVICFCLLGITCAIPVKQADSGSSEEKQLYNKYPDAVATWLNPDPSQ  50
||||||||||||||||||||||||||||||||||||||||||||||||||   1
MRIAVICFCLLGITCAIPVKQADSGSSEEKQLYNKYPDAVATWLNPDPSQ  50 . . . 51

KQNLLAPQ                                            58
||||||||                                            51
KQNLLAPQ                                            58
```

Sequence name: OSTP_HUMAN (SEQ ID NO:552)

Sequence documentation:

Alignment of: HUMOSTRO_PEA.sub.--1_PEA.sub.--1_P25 (SEQ ID NO:554).times.OSTP_HUMAN (SEQ ID NO:552).

Alignment segment 1/1: TABLE-US-00947 Quality: 301.00 Escore: 0 Matching length: 31 Total length: 31 Matching Percent 100.00 Matching Percent Identity: 100.00 Similarity: Total Percent Similarity: 100.00 Total Percent Identity: 100.00 Gaps: 0

```
Alignment: TABLE-US-00948 . . . 1
  MRIAVICFCLLGITCAIPVKQADSGSSEEKQ              31
  ||||||||||||||||||||||||||||||||              1
  MRIAVICFCLLGITCAIPVKQADSGSSEEKQ              31
```

Sequence name: OSTP_HUMAN (SEQ ID NO:552)

Sequence documentation:

Alignment of: HUMOSTRO_PEA.sub.--1_PEA.sub.--1_P30 (SEQ ID NO:555).times.OSTP_HUMAN (SEQ ID NO:552).

Alignment segment 1/1: TABLE-US-00949 Quality: 301.00 Escore: 0 Matching length: 31 Total length: 31 Matching Percent 100.00 Matching Percent Identity: 100.00 Similarity: Total Percent Similarity: 100.00 Total Percent Identity: 100.00 Gaps: 0

```
Alignment: TABLE-US-00950 . . . 1
  MRIAVICFCLLGITCAIPVKQADSGSSEEKQ              31
  ||||||||||||||||||||||||||||||||              1
  MRIAVICFCLLGITCAIPVKQADSGSSEEKQ              31
```

Description for Cluster R11723

Cluster R11723 features 6 transcript(s) and 26 segment(s) of interest, the names for which are given in Tables 1 and 2, respectively, the sequences themselves are given at the end of the application. The selected protein variants are given in table 3. TABLE-US-00951 TABLE 1 Transcripts of interest Transcript Name Sequence ID No. R11723_PEA_1_T15 556 R11723_PEA_1_T17 557 R11723_PEA_1_T19 558 R11723_PEA_1_T20 559 R11723_PEA_1_T5 560 R11723_PEA_1_T6 561

TABLE-US-00952 TABLE 2 Segments of interest Segment Name Sequence ID No. R11723_PEA_1_node_13 562 R11723_PEA_1_node_16 563 R11723_PEA_1_node_19 564 R11723_PEA_1_node_2 565 R11723_PEA_1_node_22 566 R11723_PEA_1_node_31 567 R11723_PEA_1_node_10 568 R11723_PEA_1_node_11 569 R11723_PEA_1_node_15 570 R11723_PEA_1_node_18 571 R11723_PEA_1_node_20 572 R11723_PEA_1_node_21 573 R11723_PEA_1_node_23 574 R11723_PEA_1_node_24 575 R11723_PEA_1_node_25 576 R11723_PEA_1_node_26 577 R11723_PEA_1_node_27 578 R11723_PEA_1_node_28 579 R11723_PEA_1_node_29 580 R11723_PEA_1_node_3 581 R11723_PEA_1_node_30 582 R11723_PEA_1_node_4 583 R11723_PEA_1_node_5 584 R11723_PEA_1_node_6 585 R11723_PEA_1_node_7 586 R11723_PEA_1_node_8 587

TABLE-US-00953 TABLE 3 Proteins of interest Protein Name Sequence ID No. R11723_PEA_1_P2 588 R11723_PEA_1_P6 589 R11723_PEA_1_P7 590 R11723_PEA_1_P13 591 R11723_PEA_1_P10 592

Cluster R11723 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 38 refer to weighted expression of ESTs in each category, as "parts per million" (ratio of the expression of ESTs for a particular cluster to the expression of all ESTs in that category, according to parts per million).

Figure 38:
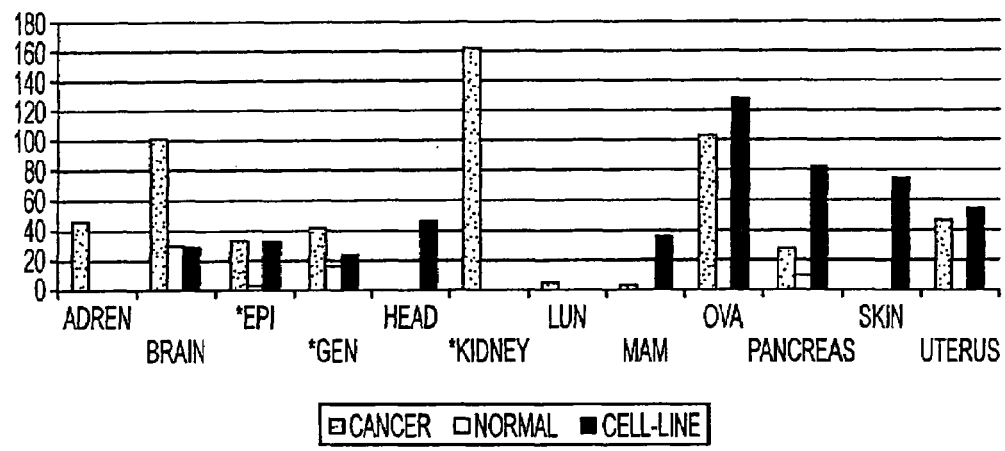
FIG. 38 is a histogram showing Cancer and cell-line vs. normal tissue expression for Cluster R11723, demonstrating overexpression in epithelial malignant tumors, a mixture of malignant tumors from different tissues and kidney malignant tumors.

Overall, the following results were obtained as shown with regard to the histograms in FIG. 38 and Table 4. This cluster is overexpressed (at least at a minimum level) in the following pathological conditions: epithelial malignant tumors, a mixture of malignant tumors from different tissues and kidney malignant tumors. TABLE-US-00954 TABLE 4 Normal tissue distribution Name of Tissue Number adrenal 0 brain 30 epithelial 3 general 17 head and neck 0 kidney 0 lung 0 breast 0 ovary 0 pancreas 10 skin 0 uterus 0

TABLE-US-00955 TABLE 5 P values and ratios for expression in cancerous tissue Name of Tissue P1 P2 SP1 R3 SP2 R4 adrenal 4.2e-01 4.6e-01 4.6e-01 2.2 5.3e-01 1.9 brain 2.2e-01 2.0e-01 1.2e-02 2.8 5.0e-02 2.0 epithelial 3.0e-05 6.3e-05 1.8e-05 6.3 3.4e-06 6.4 general 7.2e-03 4.0e-02 1.3e-04 2.1 1.1e-03 1.7 head and neck 1 5.0e-01 1 1.0 7.5e-01 1.3 kidney 1.5e-01 2.4e-01 4.4e-03 5.4 2.8e-02 3.6 lung 1.2e-01 1.6e-01 1 1.6 1 1.3 breast 5.9e-01 4.4e-01 1 1.1 6.8e-01 1.5 ovary 1.6e-02 1.3e-02 1.0e-01 3.8 7.0e-02 3.5 pancreas 5.5e-01 2.0e-01 3.9e-01 1.9 1.4e-01 2.7 skin 1 4.4e-01 1 1.0 1.9e-02 2.1 uterus 1.5e-02 5.4e-02 1.9e-01 3.1 1.4e-01 2.5

As noted above, cluster R11723 features 6 transcript(s), which were listed in Table 1 above. A description of each variant protein according to the present invention is now provided.

Variant protein R11723_PEA.sub.--1_P2 (SEQ ID NO:588) according to the present invention has an amino acid sequence as given at the end of the application; it is encoded by transcript(s) R11723_PEA.sub.--1_T6 (SEQ ID NO:561). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA.sub.--1_P2 (SEQ ID NO:588) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein R11723_PEA.sub.--1_P2 (SEQ ID NO:588) sequence provides support for the deduced sequence of this variant protein according to the present invention). TABLE-US-00956 TABLE 6 Amino acid mutations SNP position(s) on amino acid Alternative sequence amino acid(s) Previously known SNP? 107 H→P Yes 70 G→No 70 G→C No Variant protein R11723_PEA.sub.--1_P2 (SEQ ID NO:588) is encoded by the following transcript(s): R11723_PEA.sub.--1_T6 (SEQ ID NO:561), for which the sequence(s) is/are given at the end of the application. The coding portion of transcript R11723_PEA.sub.--1_T6 (SEQ ID NO:561) is shown in bold; this coding portion starts at position 1716 and ends at position 2051. The transcript also has the following SNPs as listed in Table 7 (given according to their position on the nucleotide sequence, with the alternative nucleic acid listed; the last column indicates whether the SNP is known or not; the presence of known SNPs in variant protein R11723_PEA.sub.--1_P2 (SEQ ID NO:588) sequence provides support for the deduced sequence of this variant protein according to the present invention). TABLE-US-00957 TABLE 7 Nucleic acid SNPs SNP position on Alternative Previously nucleotide sequence nucleic acid known SNP? 1231 C→T Yes 1278 G→C Yes 1923 G→No 1923 G→T No 2035 A→C Yes 2048 A→C No 2057 A→G Yes Variant protein R11723_PEA.sub.--1_P6 (SEQ ID NO:589) according to the present invention has an amino acid sequence as given at the end of the application; it is encoded by transcript(s) R11723_PEA.sub.--1_T15 (SEQ ID NO:556). One or more alignments to one or more previously published protein sequences are given at the end of the application. A brief description of the relationship of the variant protein according to the present invention to each such aligned protein is as follows:

Comparison report between R11723_PEA.sub.--1_P6 (SEQ ID NO:589) and Q8IXM0 (SEQ ID NO:885):

1. An isolated chimeric polypeptide encoding for R11723_PEA.sub.--1_P6 (SEQ ID NO:589), comprising a first amino acid sequence being at least 70%, optionally at least 80%, preferably at least 85%, more preferably at least 90% and most preferably at least 95% homologous to a polypeptide having the sequence MWVLGIAATFCGLFLL-PGFALQIQCYQCEEFQLNNDC-SSPEFIVNCTVNVQDMCQKEV MEJQSAGIMYRK-SCASSAACLIASAGSPCRGLAPGREEQRALHKAGAV GGGVR (SEQ ID NO:1022) corresponding to amino acids 1-110 of R11723_PEA.sub.--1_P6 (SEQ ID NO:589), and a second amino acid sequence being at least 90% homologous to MYAQALLVVGVLQRQAAAQHLHEHPP-KLLRGHRVQERVDDRAEVEKRLREGEEDHV RPEVG-PRPVVLGFGRSHDPPNLVGH-PAYGQCHNNQPWADTSRRERQRKEKHSMRTQ corresponding to amino acids 1-112 of Q8IXM0, which also corresponds to amino acids 111-222 of R11723_PEA.sub.--1_P6 (SEQ ID NO:589), wherein said first and second amino acid sequences are contiguous and in a sequential order.

2. An isolated polypeptide encoding for a head of R11723_PEA.sub.--1_P6 (SEQ ID NO:589), comprising a polypeptide being at least 70%, optionally at least about 80%, preferably at least about 85%, more preferably at least about 90% and most preferably at least about 95% homologous to the sequence TABLE-US-00958 MWVLGIAATFCGLFLL-PGFALQIQCYQCEEFQLNNDC-SSPEFIVNCTVNVQDMCQKEV (SEQ ID NO: 1022) MEQSAGIMYRKSCASSAACLIASAG-SPCRGLAPGREEQRALHKAGAVGGGVR of R11723_PEA__1_P6. (SEQ ID NO:589)

Comparison report between R11723_PEA.sub.--1_P6 (SEQ ID NO:589) and Q96AC2 (SEQ ID NO:886):

1. An isolated chimeric polypeptide encoding for R11723_PEA.sub.--1_P6 (SEQ ID NO:589), comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 1-83 of Q96AC2 (SEQ ID NO: 886), which also corresponds to amino acids 1-83 of R11723_PEA.sub.--1_P6 (SEQ ID NO:589), and a second amino acid sequence being at least 70%, optionally at least 80%, preferably at least 85%, more preferably at least 90% and most preferably at least 95% homologous to a polypeptide having the sequence SPCR-GLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO: 1023) corresponding to amino acids 84-222 of R11723_PEA.sub.--1_P6 (SEQ ID NO:589), wherein said first and second amino acid sequences are contiguous and in a sequential order.

2. An isolated polypeptide encoding for a tail of R11723_PEA.sub.--1_P6 (SEQ ID NO:589), comprising a polypeptide being at least 70%, optionally at least about 80%, preferably at least about 85%, more preferably at least about 90% and most preferably at least about 95% homologous to the sequence TABLE-US-00959 SPCRGLAPGREEQRAL-HKAGAVGGGVRMYAQALLVVG-LQRQAAAQHLHEHPPKLL (SEQ ID NO: 1023) RGH-RVQERVDDRAEVEKRLREGEEDHVRPEVGPRPVVL GFGRSHDPPNLVGHPAYGQ CHNNQPWADTSRRER-QRKEKHSMRTQ in R11723_PEA_1_P6. (SEQ ID NO:589)

Comparison report between R11723_PEA.sub.--1_P6 (SEQ ID NO:589) and Q8N2G4 (SEQ ID NO:887):

1. An isolated chimeric polypeptide encoding for R11723_PEA.sub.--1_P6 (SEQ ID NO:589), comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 1-83 of Q8N2G4, which also corresponds to amino acids 1-83 of R11723_PEA.sub.--1_P6 (SEQ ID NO:589), and a second amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO:1023) corresponding to amino acids 84-222 of R11723_PEA.sub.--1_P6 (SEQ ID NO:589), wherein said first and second amino acid sequences are contiguous and in a sequential order.

2. An isolated polypeptide encoding for a tail of R11723_PEA.sub.--1_P6 (SEQ ID NO:589), comprising a polypeptide being at least 70%, optionally at least about 80%, preferably at least about 85%, more preferably at least about 90% and most preferably at least about 95% homologous to the sequence TABLE-US-00960 SPCRGLAPGREEQRAL-HKAGAVGGGVRMYAQALLVVGV-LQRQAAAQHLHEHPPKLL (SEQ ID NO: 1023) RGH-RVQERVDRAEVEKRLREGEEDHVRPEVGPRPVVLG FGRSHDPPNLVGHPAYGQ CHNNQPWADTSRRER-QRKEKHSMRTQ in R11723_PEA_1_P6. (SEQ ID NO:589)

Comparison report between R11723_PEA.sub.--1_P6 (SEQ ID NO:589) and BAC85518 (SEQ ID NO:888):

1. An isolated chimeric polypeptide encoding for R11723_PEA.sub.--1_P6 (SEQ ID NO:589), comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 24-106 of BAC85518, which also corresponds to amino acids 1-83 of R11723_PEA.sub.--1_P6 (SEQ ID NO:589), and a second amino acid sequence being at least 70%, optionally at least 80%, preferably at least 85%, more preferably at least 90% and most preferably at least 95% homologous to a polypeptide having the sequence SPCR-GLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO:1023) corresponding to amino acids 84-222 of R11723_PEA.sub.--1_P6 (SEQ ID NO:589), wherein said first and second amino acid sequences are contiguous and in a sequential order.

2. An isolated polypeptide encoding for a tail of R11723_PEA.sub.--1_P6 (SEQ ID NO:589), comprising a polypeptide being at least 70%, optionally at least about 80%, preferably at least about 85%, more preferably at least about 90% and most preferably at least about 95% homologous to the sequence TABLE-US-00961 SPCRGLAPGREEQRAL-HKAGAVGGGVRMYAQALLVVGV-LQRQAAAQHLHEHPPKLL (SEQ ID NO:1023) RGH-RVQERVDDRAEVEKRLREGEEDHVRPEVGPRPVVL GFGRSHDPPNLVGHPAYGQ CHNNQPWADTSRRER-QRKEKHSMRTQ in R11723_PEA_1_P6. (SEQ ID NO:589)

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA.sub.--1_P6 (SEQ ID NO:589) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein R11723_PEA.sub.--1_P6 (SEQ ID NO:589) sequence provides support for the deduced sequence of this variant protein according to the present invention). TABLE-US-00962 TABLE 8 Amino acid mutations SNP position(s) on amino acid Alternative sequence amino acid(s) Previously known SNP? 180 G→No 180 G→C No 217 H→P Yes Variant protein R11723_PEA.sub.--1_P6 (SEQ ID NO:589) is encoded by the following transcript(s): R11723_PEA.sub.--1_T15 (SEQ ID NO:556), for which the sequence(s) is/are given at the end of the application. The coding portion of transcript R11723_PEA.sub.--1_T15 (SEQ ID NO:556) is shown in bold; this coding portion starts at position 434 and ends at position 1099. The transcript also has the following SNPs as listed in Table 9 (given according to their position on the nucleotide sequence, with the alternative nucleic acid listed; the last column indicates whether the SNP is known or not; the presence of known SNPs in variant protein R11723_PEA.sub.--1_P6 (SEQ ID NO:589) sequence provides support for the deduced sequence of this variant protein according to the present invention). TABLE-US-00963 TABLE 9 Nucleic acid SNPs SNP position on Alternative Previously nucleotide sequence nucleic acid known SNP? 971 G→No 971 G→T No 1083A→C Yes 1096A→C No 1105A→G Yes Variant protein R11723_PEA.sub.--1_P7 (SEQ ID NO:590) according to the present invention has an amino acid sequence as given at the end of the application; it is encoded by transcript(s) R11723_PEA.sub.--1_T17 (SEQ ID NO:557). One or more alignments to one or more previously published protein sequences are given at the end of the application. A brief description of the relationship of the variant protein according to the present invention to each such aligned protein is as follows:

Comparison report between R11723_PEA.sub.--1_P7 (SEQ ID NO:590) and Q96AC2 (SEQ ID NO: 886):

1. An isolated chimeric polypeptide encoding for R11723_PEA.sub.--1_P7 (SEQ ID NO:590), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 1-64 of Q96AC2 (SEQ ID NO: 886), which also corresponds to amino acids 1-64 of R11723_PEA.sub.--1_P7 (SEQ ID NO:590), and a second amino acid sequence being at least 70%, optionally at least 80%, preferably at least 85%, more preferably at least 90% and most preferably at least 95% homologous to a polypeptide having the sequence SHCVTRLECSGTISAH- CNLCLPGSNDHPT (SEQ ID NO:1024) corresponding to amino acids 65-93 of R11723_PEA.sub.--1_P7 (SEQ ID NO:590), wherein said first and second amino acid sequences are contiguous and in a sequential order.

2. An isolated polypeptide encoding for a tail of R11723_PEA.sub.--1_P7 (SEQ ID NO:590), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO:1024) in R11723_PEA.sub.--1_P7 (SEQ ID NO:590).

Comparison report between R11723_PEA.sub.--1_P7 (SEQ ID NO:590) and Q8N2G4:

1. An isolated chimeric polypeptide encoding for R11723_PEA.sub.--1_P7 (SEQ ID NO:590), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 1-64 of Q8N2G4, which also corresponds to amino acids 1-64 of R11723_PEA.sub.--1_P7 (SEQ ID NO:590), and a second amino acid sequence being at least 70%, optionally at least 80%, preferably at least 85%, more preferably at least 90% and most preferably at least 95% homologous to a polypeptide having the sequence SHCVTRLECSGTISAHCN-LCLPGSNDHPT (SEQ ID NO:1024) corresponding to amino acids 65-93 of R11723_PEA.sub.--1_P7 (SEQ ID NO:590), wherein said first and second amino acid sequences are contiguous and in a sequential order.

2. An isolated polypeptide encoding for a tail of R11723_PEA.sub.--1_P7 (SEQ ID NO:590), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO:1024) in R11723_PEA.sub.--1_P7 (SEQ ID NO:590).

Comparison report between R11723_PEA.sub.--1_P7 (SEQ ID NO:590) and BAC85273:

1. An isolated chimeric polypeptide encoding for R11723_PEA.sub.--1_P7 (SEQ ID NO:590), comprising a first amino acid sequence being at least 70%, optionally at least 80%, preferably at least 85%, more preferably at least 90% and most preferably at least 95% homologous to a polypeptide having the sequence MWVLG (SEQ ID NO:1025) corresponding to amino acids 1-5 of R11723_PEA.sub.--1_P7 (SEQ ID NO:590), second amino acid sequence being at least 90% homologous to IAAT-FCGLFLLPGFALQIQCYQCEEFQLNNDC-SSPEFIVNCTVNVQDMCQKEVMEQSAG corresponding to amino acids 22-80 of BAC85273, which also corresponds to amino acids 6-64 of R11723_PEA.sub.--1_P7 (SEQ ID NO:590), and a third amino acid sequence being at least 70%, optionally at least 80%, preferably at least 85%, more preferably at least 90% and most preferably at least 95% homologous to a polypeptide having the sequence SHCVTRLECS-GTISAHCNLCLPGSNDHPT (SEQ ID NO:1024) corresponding to amino acids 65-93 of R11723_PEA.sub.--1_P7 (SEQ ID NO:590), wherein said first, second and third amino acid sequences are contiguous and in a sequential order.

2. An isolated polypeptide encoding for a head of R11723_PEA.sub.--1_P7 (SEQ ID NO:590), comprising a polypeptide being at least 70%, optionally at least about 80%, preferably at least about 85%, more preferably at least about 90% and most preferably at least about 95% homologous to the sequence MWVLG (SEQ ID NO:1025) of R11723_PEA.sub.--1_P7 (SEQ ID NO:590).

3. An isolated polypeptide encoding for a tail of R11723_PEA.sub.--1_P7 (SEQ ID NO:590), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO:1024) in R11723_PEA.sub.--1_P7 (SEQ ID NO:590).

Comparison report between R11723_PEA.sub.--1_P7 (SEQ ID NO:590) and BAC85518:

1. An isolated chimeric polypeptide encoding for R11723_PEA.sub.--1_P7 (SEQ ID NO:590), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 24-87 of BAC85518, which also corresponds to amino acids 1-64 of R11723_PEA.sub.--1_P7 (SEQ ID NO:590), and a second amino acid sequence being at least 70%, optionally at least 80%, preferably at least 85%, more preferably at least 90% and most preferably at least 95% homologous to a polypeptide having the sequence SHCVTRLECSGTISAHCN-LCLPGSNDHPT (SEQ ID NO:1024) corresponding to amino acids 65-93 of R11723_PEA.sub.--1_P7 (SEQ ID NO:590), wherein said first and second amino acid sequences are contiguous and in a sequential order.

2. An isolated polypeptide encoding for a tail of R11723_PEA.sub.--1_P7 (SEQ ID NO:590), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO:1024) in R11723_PEA.sub.--1_P7 (SEQ ID NO:590).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA.sub.--1_P7 (SEQ ID NO:590) also has the following non-silent SNPs (Single Nucleotide Polymorphisms) as listed in Table 10, (given according to their position(s) on the amino acid sequence, with the alternative amino acid(s) listed; the last column indicates whether the SNP is known or not; the presence of known SNPs in variant protein R11723_PEA.sub.--1_P7 (SEQ ID NO:590) sequence provides support for the deduced sequence of this variant protein according to the present invention). TABLE-US-00964 TABLE 10 Amino acid mutations SNP position(s) on amino acid Alternative sequence amino acid(s) Previously known SNP? 67 C→S Yes Variant protein R11723_PEA.sub.--1_P7 (SEQ ID NO:590) is encoded by the following transcript(s): R11723_PEA.sub.--1_T17 (SEQ ID NO:557), for which the sequence(s) is/are given at the end of the application. The coding portion of transcript R11723_PEA.sub.--1_T17 (SEQ ID NO:557) is shown in bold; this coding portion starts at position 434 and ends at position 712. The transcript also has the following SNPs as listed in Table 11 (given according to their position on the nucleotide sequence, with the alternative nucleic acid listed; the last column indicates whether the SNP is known or not; the presence of known SNPs in variant protein R11723_PEA.sub.--1_P7 (SEQ ID NO:590) sequence provides support for the deduced sequence of this variant protein according to the present invention). TABLE-US-00965 TABLE 11 Nucleic acid SNPs SNP position on Alternative Previously nucleotide sequence nucleic acid known SNP? 625 G→T Yes 633 G→C Yes 1303 C→T Yes Variant protein R11723_PEA.sub.--1_P13 (SEQ ID NO:591) according to the present invention has an amino acid sequence as given at the end of the application; it is encoded by transcript(s) R11723_PEA.sub.--1_T19 (SEQ ID NO:558). One or more alignments to one or more previously published protein sequences are given at the end of the application. A brief description of the relationship of the variant protein according to the present invention to each such aligned protein is as follows:

Comparison report between R11723_PEA.sub.--_P13 (SEQ ID NO:591) and Q96AC2 (SEQ ID NO: 886):

1. An isolated chimeric polypeptide encoding for R11723_PEA.sub.--1_P13 (SEQ ID NO:591) comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q96AC2 (SEQ ID NO: 886), which also corresponds to amino acids 1-63 of R11723_PEA.sub.--1_P13 (SEQ ID NO:591), and a second amino acid sequence being at least 70%, optionally at least 80%, preferably at least 85%, more preferably at least 90% and most preferably at least 95% homologous to a polypeptide having the sequence DTKRTNTLLFEM-RHFAKQLTT (SEQ ID NO:1026) corresponding to amino acids 64-84 of R11723_PEA.sub.--1_P13 (SEQ ID NO:591), wherein said first and second amino acid sequences are contiguous and in a sequential order.

2. An isolated polypeptide encoding for a tail of R1723_PEA.sub.--1_P13 (SEQ ID NO:591), comprising a polypeptide being at least 70%, optionally at least about 80%, preferably at least about 85%, more preferably at least about 90% and most preferably at least about 95% homologous to the sequence DTKRTNTLLFEMRHFAKQLTT (SEQ ID NO:1026) in R11723_PEA.sub.--1_P13 (SEQ ID NO:591).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA.sub.--1_P13 (SEQ ID NO:591) is encoded by the following transcript(s): R11723_PEA.sub.--1_T19 (SEQ ID NO:558) and R11723_PEA.sub.--1_T5 (SEQ ID NO:560), for which the sequence(s) is/are given at the end of the application. The coding portion of transcript R11723_PEA.sub.--1_T19 (SEQ ID NO:558) is shown in bold; this coding portion starts at position 434 and ends at position 685. The transcript also has the following SNPs as listed in Table 12 (given according to their position on the nucleotide sequence, with the alternative nucleic acid listed; the last column indicates whether the SNP is known or not; the presence of known SNPs in variant protein R1172_PEA.sub.--1_P13 (SEQ ID NO:591) sequence provides support for the deduced sequence of this variant protein according to the present invention). TABLE-US-00966 TABLE 12 Nucleic acid SNPs SNP position on Alternative Previously nucleotide sequence nucleic acid known SNP? 778 G→T Yes 786 G→C Yes 1456 C→T Yes Variant protein R11723_PEA.sub.--1_P10 (SEQ ID NO:592) according to the present invention has an amino acid sequence as given at the end of the application; it is encoded by transcript(s) R11723_PEA.sub.--1_T20 (SEQ ID NO:559). One or more alignments to one or more previously published protein sequences are given at the end of the application. A brief description of the relationship of the variant protein according to the present invention to each such aligned protein is as follows:

Comparison report between R11723_PEA.sub.--1_P10 (SEQ ID NO:592) and Q96AC2 (SEQ ID NO: 886):

1. An isolated chimeric polypeptide encoding for R11723_PEA.sub.--1_P10 (SEQ ID NO:592) comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q96AC2 (SEQ ID NO: 886), which also corresponds to amino acids 1-63 of R11723_PEA.sub.--1_P10 (SEQ ID NO:592), and a second amino acid sequence being at least 70%, optionally at least 80%, preferably at least 85%, more preferably at least 90% and most preferably at least 95% homologous to a polypeptide having the sequence DRVSLCHEAGVQWNN-FSTLQPLPPRLK (SEQ ID NO:1027) corresponding to amino acids 64-90 of R11723_PEA.sub.--1_P10 (SEQ ID NO:592), wherein said first and second amino acid sequences are contiguous and in a sequential order.

2. An isolated polypeptide encoding for a tail of R11723_PEA.sub.--1_P10 (SEQ ID NO:592), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1027) in R11723_PEA.sub.--1_P10 (SEQ ID NO:592).

Comparison report between R11723_PEA.sub.--1_P10 (SEQ ID NO:592) and Q8N2G4:

1. An isolated chimeric polypeptide encoding for R11723_PEA.sub.--1_P10 (SEQ ID NO:592), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q8N2G4, which also corresponds to amino acids 1-63 of R11723_PEA.sub.--1_P10 (SEQ ID NO:592), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQ-PLPPRLK (SEQ ID NO:1027) corresponding to amino acids 64-90 of R11723_PEA.sub.--1_P10 (SEQ ID NO:592), wherein said first and second amino acid sequences are contiguous and in a sequential order.

2. An isolated polypeptide encoding for a tail of R11723_PEA.sub.--1_P10 (SEQ ID NO:592), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1027) in R11723_PEA.sub.--1_P10 (SEQ ID NO:592).

Comparison report between R11723_PEA.sub.--1_P10 (SEQ ID NO:592) and BAC85273:

1. An isolated chimeric polypeptide encoding for R11723_PEA.sub.--1_P10 (SEQ ID NO:592) comprising a first amino acid sequence being at least 70%, optionally at least 80%, preferably at least 85%, more preferably at least 90% and most preferably at least 95% homologous to a polypeptide having the sequence MWVLG (SEQ ID NO:1025) corresponding to amino acids 1-5 of R11723_PEA.sub.--1_P10 (SEQ ID NO:592), second amino acid sequence being at least 90% homologous to IAATFCGLFLLPGFALQIQCYQCEEFQLNNDCSSPEFIVNCTVNVQDMCQKEVMEQSA corresponding to amino acids 22-79 of BAC85273, which also corresponds to amino acids 6-63 of R11723_PEA.sub.--1_P10 (SEQ ID NO:592), and a third amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO:1027) corresponding to amino acids 64-90 of R11723_PEA.sub.--1_P10 (SEQ ID NO:592), wherein said first, second and third amino acid sequences are contiguous and in a sequential order.

2. An isolated polypeptide encoding for a head of R11723_PEA.sub.--1_P10 (SEQ ID NO:592) comprising a polypeptide being at least 70%, optionally at least about 80%, preferably at least about 85%, more preferably at least about 90% and most preferably at least about 95% homologous to the sequence MWVLG (SEQ ID NO:1025) of R11723_PEA.sub.--1_P10 (SEQ ID NO:592)

3. An isolated polypeptide encoding for a tail of R11723_PEA.sub.--1_P10 (SEQ ID NO:592), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1027) in R11723_PEA.sub.--1_P10 (SEQ ID NO:592).

Comparison report between R11723_PEA.sub.--1_P10 (SEQ ID NO:592) and BAC85518:

1. An isolated chimeric polypeptide encoding for R11723_PEA.sub.--1_P10 (SEQ ID NO:592), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 24-86 of BAC85518, which also corresponds to amino acids 1-63 of R11723_PEA.sub.--1_P10 (SEQ ID NO:592), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO:1027) corresponding to amino acids 64-90 of R11723_PEA.sub.--1_P10 (SEQ ID NO:592), wherein said first and second amino acid sequences are contiguous and in a sequential order.

2. An isolated polypeptide encoding for a tail of R11723_PEA.sub.--1_P10 (SEQ ID NO:592), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1027) in R11723_PEA.sub.--1_P10 (SEQ ID NO:592).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA.sub.--1_P10 (SEQ ID NO:592) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein R11723_PEA.sub.--1_P10 (SEQ ID NO:592) sequence provides support for the deduced sequence of this variant protein according to the present invention). TABLE-US-00967 TABLE 13 Amino acid mutations SNP position(s) on amino acid Alternative sequence amino acid(s) Previously known SNP? 66 V→F Yes Variant protein R11723_PEA.sub.--1_P10 (SEQ ID NO:592) is encoded by the following transcript(s): R11723_PEA.sub.--1_T20 (SEQ ID NO:559), for which the sequence(s) is/are given at the end of the application. The coding portion of transcript R11723_PEA.sub.--1_T20 (SEQ ID NO:559) is shown in bold; this coding portion starts at position 434 and ends at position 703. The transcript also has the following SNPs as listed in Table 14 (given according to their position on the nucleotide sequence, with the alternative nucleic acid listed; the last column indicates whether the SNP is known or not; the presence of known SNPs in variant protein R11723_PEA.sub.--1_P10 (SEQ ID NO:592) sequence provides support for the deduced sequence of this variant protein according to the present invention). TABLE-US-00968 TABLE 14 Nucleic acid SNPs SNP position on Alternative Previously nucleotide sequence nucleic acid known SNP? 629 G→T Yes 637 G→C Yes 1307 C→T Yes As noted above, cluster R11723 features 26 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster R11723_PEA.sub.--1_node.sub.--13 (SEQ ID NO:562) according to the present invention is supported by 5 libraries. The number of libraries was determined as previously described. This segment can be found in the following transcript(s): R11723_PEA.sub.--1_T19 (SEQ ID NO:558), R11723_PEA.sub.--1_T5 (SEQ ID NO:560) and R11723_PEA.sub.--1_T6 (SEQ ID NO:561). Table 15 below describes the starting and ending position of this segment on each transcript. TABLE-US-00969 TABLE 15 Segment location on transcripts Segment Segment Transcript name starting position ending position R11723_PEA__1_T19 (SEQ 624 776 ID NO: 558) R11723_PEA__1_T5 (SEQ ID 624 776 NO: 560) R11723_PEA__1_T6 (SEQ ID 658 810 NO: 561)

Segment cluster R11723_PEA.sub.--1_node.sub.--16 (SEQ ID NO:563) according to the present invention is supported by 3 libraries. The number of libraries was determined as previously described. This segment can be found in the following transcript(s): R11723_PEA.sub.--1_T17 (SEQ ID NO:557), R11723_PEA.sub.--1_T19 (SEQ ID NO:558) and R11723_PEA.sub.--1_T20 (SEQ ID NO:559). Table 16 below describes the starting and ending position of this segment on each transcript. TABLE-US-00970 TABLE 16 Segment location on transcripts Segment starting Segment ending Transcript name position position R11723_PEA_1_T17 (SEQ 624 1367 ID NO: 557) R11723_PEA_1_T19 (SEQ 777 1520 ID NO: 558) R11723_PEA_1_T20 (SEQ 628 1371 ID NO: 559)

Segment cluster R11723_PEA.sub.--1_node.sub.--19 (SEQ ID NO:564) according to the present invention is supported by 45 libraries. The number of libraries was determined as previously described. This segment can be found in the following transcript(s): R11723_PEA.sub.--1_T5 (SEQ ID NO:560) and R11723_PEA.sub.--1_T6 (SEQ ID NO:561). Table 17 below describes the starting and ending position of this segment on each transcript. TABLE-US-00971 TABLE 17 Segment location on transcripts Segment Segment Transcript name starting position ending position R11723_PEA_1_T5 (SEQ ID 835 1008 NO: 560) R11723_PEA_1_T6 (SEQ ID 869 1042 NO: 561)

Segment cluster R11723_PEA.sub.--1_node.sub.--2 (SEQ ID NO:565) according to the present invention is supported by 29 libraries. The number of libraries was determined as previously described. This segment can be found in the following transcript(s): R11723_PEA.sub.--1_T5 (SEQ ID NO:556), R11723_PEA.sub.--1_T17 (SEQ ID NO:557), R11723_PEA.sub.--1_T19 (SEQ ID NO:558), R11723_PEA.sub.--1_T20 (SEQ ID NO:559), R11723_PEA.sub.--1_T5 (SEQ ID NO:560) and R11723_PEA.sub.--1_T6 (SEQ ID NO:561). Table 18 below describes the starting and ending position of this segment on each transcript. TABLE-US-00972 TABLE 18 Segment location on transcripts Segment Segment Transcript name starting position ending position R11723_PEA_1_T15 (SEQ 1 309 ID NO: 556) R11723_PEA_1_T17 (SEQ 1 309 ID NO: 557) R11723_PEA_1_T19 (SEQ 1 309 ID NO: 558) R11723_PEA_1_T20 (SEQ 1 309 ID NO: 559) R11723_PEA_1_T5 (SEQ ID 1 309 NO: 560) R11723_PEA_1_T6 (SEQ ID 1 309 NO: 561)

Segment cluster R11723_PEA.sub.--1_node.sub.--22 (SEQ ID NO:566) according to the present invention is supported by 65 libraries. The number of libraries was determined as previously described. This segment can be found in the following transcript(s): R11723_PEA.sub.--1_T5 (SEQ ID NO:560) and R11723_PEA.sub.--1_T6 (SEQ ID NO:561). Table 19 below describes the starting and ending position of this segment on each transcript. TABLE-US-00973 TABLE 19 Segment location on transcripts Segment Segment Transcript name starting position ending position R11723_PEA_1_T5 (SEQ ID 1083 1569 NO: 560) R11723_PEA_1_T6 (SEQ ID 1117 1603 NO: 561)

Segment cluster R11723_PEA.sub.--1_node.sub.--31 (SEQ ID NO:567) according to the present invention is supported by 70 libraries. The number of libraries was determined as previously described. This segment can be found in the following transcript(s): R11723_PEA.sub.--1_T15 (SEQ ID NO:556), R11723_PEA.sub.--1_T5 (SEQ ID NO:560) and R11723_PEA.sub.--1_T6 (SEQ ID NO:561). Table 20 below describes the starting and ending position of this segment on each transcript (it should be noted that these transcripts show alternative polyadenylation). TABLE-US-00974 TABLE 20 Segment location on transcripts Segment Segment Transcript name starting position ending position R11723_PEA_1_T15 (SEQ 1060 1295 ID NO: 556) R11723_PEA_1_T5 (SEQ ID 1978 2213 NO: 560) R11723_PEA_1_T6 (SEQ ID 2012 2247 NO: 561)

According to an optional embodiment of the present invention, short segments related to the above cluster are also provided. These segments are up to about 120 bp in length, and so are included in a separate description.

Segment cluster R11723_PEA.sub.--1_node.sub.--10 (SEQ ID NO:568) according to the present invention is supported by 38 libraries. The number of libraries was determined as previously described. This segment can be found in the following transcript(s): R11723_PEA.sub.--1_T15 (SEQ ID NO:556) R11723_PEA.sub.--1_T17 (SEQ ID NO:557), R11723.sub.--1_PEA.sub.--1_T19(SEQ ID NO:558), R11723_PEA.sub.--1_T20 (SEQ ID NO:559), R11723_PEA.sub.--1_T5 (SEQ ID NO:560) and R11723_PEA.sub.--1_T6 (SEQ ID NO:561). Table 21 below describes the starting and ending position of this segment on each transcript. TABLE-US-00975 TABLE 21 Segment location on transcripts Segment Segment Transcript name starting position ending position R11723_PEA_1_T15 (SEQ 486 529 ID NO: 556) R11723_PEA_1_T17 (SEQ 486 529 ID NO: 557) R11723_PEA_1_T19 (SEQ 486 529 ID NO: 558) R11723_PEA_1_T20 (SEQ 486 529 ID NO: 559) R11723_PEA_1_T5 (SEQ ID 486 529 NO: 560) R11723_PEA_1_T6 (SEQ ID 520 563 NO: 561)

Segment cluster R11723_PEA.sub.--1_node.sub.--11 (SEQ ID NO:569) according to the present invention is supported by 42 libraries. The number of libraries was determined as previously described. This segment can be found in the following transcript(s): R11723_PEA.sub.--1_T15 (SEQ ID NO:556, R11723_PEA.sub.--1_T17(SEQ ID NO:557), R11723_PEA.sub.--1_T19(SEQ ID NO:558), R11723_PEA.sub.--1.sub.--T20 (SEQ ID NO:559), R11723_PEA.sub.--1_T5 (SEQ ID NO:560) and R11723_PEA.sub.--1_T6 (SEQ ID NO:561). Table 22 below describes the starting and ending position of this segment on each transcript. TABLE-US-00976 TABLE 22 Segment location on transcripts Segment Segment Transcript name starting position ending position R11723_PEA_1_T15 (SEQ 530 623 ID NO: 556) R11723_PEA_1_T17 (SEQ 530 623 ID NO: 557) R11723_PEA_1_T19 (SEQ 530 623 ID NO: 558) R11723_PEA_1_T20 (SEQ 530 623 ID NO: 559) R11723_PEA_1_T5 (SEQ ID 530 623 NO: 560) R11723_PEA_1_T6 (SEQ ID 564 657 NO: 561)

Segment cluster R11723_PEA.sub.--1_node.sub.--15 (SEQ ID NO:570) according to the present invention can be found in the following transcript(s): R11723_PEA.sub.--1_T20 (SEQ ID NO:559). Table 23 below describes the starting and ending position of this segment on each transcript. TABLE-US-00977 TABLE 23 Segment location on transcripts Segment Segment Transcript name starting position ending position R11723_PEA_1_T20 (SEQ 624 627 ID NO: 559)

Segment cluster R11723_PEA.sub.--1_node.sub.--18 (SEQ ID NO:571) according to the present invention is supported by 40 libraries. The number of libraries was determined as previously described. This segment can be found in the following transcript(s): R11723_PEA.sub.--1_T15 (SEQ ID NO:556), R11723_PEA.sub.--1_T5 (SEQ ID NO:560) and R11723_PEA.sub.--1_T6 (SEQ ID NO:561). Table 24 below describes the starting and ending position of this segment on each transcript. TABLE-US-00978 TABLE 24 Segment location on transcripts Segment Segment Transcript name starting position ending position R11723_PEA_1_T15 (SEQ 624 681 ID NO: 556) R11723_PEA_1_T5 (SEQ ID 777 834 NO: 560) R11723_PEA_1_T6 (SEQ ID 811 868 NO: 561)

Segment cluster R11723_PEA.sub.--1_node.sub.--20 (SEQ ID NO:572) according to the present invention can be found in the following transcript(s): R11723_PEA.sub.--1_T5 (SEQ ID NO:560) and R11723_PEA.sub.--1_T6 (SEQ ID NO:561). Table 25 below describes the starting and ending position of this segment on each transcript. TABLE-US- 00979 TABLE 25 Segment location on transcripts Segment Segment Transcript name starting position ending position R11723_PEA_1_T5 (SEQ ID 1009 1019 NO: 560) R11723_PEA_1_T6 (SEQ ID 1043 1053 NO: 561)

Segment cluster R11723_PEA.sub.--1_node.sub.--21 (SEQ ID NO:573) according to the present invention is supported by 36 libraries. The number of libraries was determined as previously described. This segment can be found in the following transcript(s): R11723_PEA.sub.--1_T5 (SEQ ID NO:560) and R11723_PEA.sub.--1_T6 (SEQ ID NO:561). Table 26 below describes the starting and ending position of this segment on each transcript. TABLE-US-00980 TABLE 26 Segment location on transcripts Segment Segment Transcript name starting position ending position R11723_PEA_1_T5 (SEQ ID 1020 1082 NO: 560) R11723_PEA_1_T6 (SEQ ID 1054 1116 NO: 561)

Segment cluster R11723_PEA.sub.--1_node.sub.--23 (SEQ ID NO:574) according to the present invention is supported by 39 libraries. The number of libraries was determined as previously described. This segment can be found in the following transcript(s): R11723_PEA.sub.--1_T5 (SEQ ID NO:560) and R11723_PEA.sub.--1_T6 (SEQ ID NO:561). Table 27 below describes the starting and ending position of this segment on each transcript. TABLE-US-00981 TABLE 27 Segment location on transcripts Segment Segment Transcript name starting position ending position R11723_PEA_1_T5 (SEQ ID 1570 1599 NO: 560) R11723_PEA_1_T6 (SEQ ID 1604 1633 NO: 561)

Segment cluster R11723_PEA.sub.--1_node.sub.--24 (SEQ ID NO:575) according to the present invention is supported by 51 libraries. The number of libraries was determined as previously described. This segment can be found in the following transcript(s): R11723_PEA.sub.--1_T15 (SEQ ID NO:556), R11723_PEA.sub.--1_T5 (SEQ ID NO:560) and R11723_PEA.sub.--1_T6 (SEQ ID NO:561). Table 28 below describes the starting and ending position of this segment on each transcript. TABLE-US-00982 TABLE 28 Segment location on transcripts Segment Segment Transcript name starting position ending position R11723_PEA_1_T15 (SEQ 682 765 ID NO: 556) R11723_PEA_1_T5 (SEQ ID 1600 1683 NO: 560) R11723_PEA_1_T6 (SEQ ID 1634 1717 NO: 561)

Segment cluster R11723_PEA.sub.--1_node.sub.--25 (SEQ ID NO:576) according to the present invention is supported by 54 libraries. The number of libraries was determined as previously described. This segment can be found in the following transcript(s): R11723_PEA.sub.--1_T15 (SEQ ID NO:556), R11723_PEA.sub.--1_T5 (SEQ ID NO:560) and R11723_PEA.sub.--1_T6 (SEQ ID NO:561). Table 29 below describes the starting and ending position of this segment on each transcript. TABLE-US-00983 TABLE 29 Segment location on transcripts Segment Segment Transcript name starting position ending position R11723_PEA_1_T15 (SEQ 766 791 ID NO: 556) R11723_PEA_1_T5 (SEQ ID 1684 1709 NO: 560) R11723_PEA_1_T6 (SEQ ID 1718 1743 NO: 561)

Segment cluster R11723_PEA.sub.--1_node.sub.--26 (SEQ ID NO:577) according to the present invention is supported by 62 libraries. The number of libraries was determined as previously described. This segment can be found in the following transcript(s): R11723_PEA.sub.--1_T15 (SEQ ID NO:556), R11723_PEA.sub.--1_T5 (SEQ ID NO:560) and R11723_PEA.sub.--1_T6 (SEQ ID NO:561). Table 30 below describes the starting and ending position of this segment on each transcript. TABLE-US-00984 TABLE 30 Segment location on transcripts Segment Segment Transcript name starting position ending position R11723_PEA_1_T15 (SEQ 792 904 ID NO: 556) R11723_PEA_1_T5 (SEQ ID 1710 1822 NO: 560) R11723_PEA_1_T6 (SEQ ID 1744 1856 NO: 561)

Segment cluster R11723_PEA.sub.--1_node.sub.--27 (SEQ ID NO:578) according to the present invention is supported by 67 libraries. The number of libraries was determined as previously described. This segment can be found in the following transcript(s): R11723_PEA.sub.--1_T15 (SEQ ID NO:556), R11723_PEA.sub.--1_T5 (SEQ ID NO:560) and R11723_PEA.sub.--1_T6 (SEQ ID NO:561). Table 31 below describes the starting and ending position of this segment on each transcript. TABLE-US-00985 TABLE 31 Segment location on transcripts Segment Segment Transcript name starting position ending position R11723_PEA_1_T15 (SEQ 905 986 ID NO: 556) R11723_PEA_1_T5 (SEQ ID 1823 1904 NO: 560) R11723_PEA_1_T6 (SEQ ID 1857 1938 NO: 561)

Segment cluster R11723_PEA.sub.--1_node.sub.--28 (SEQ ID NO:579) according to the present invention can be found in the following transcript(s): R11723_PEA.sub.--1_T15 (SEQ ID NO:556), R11723_PEA.sub.--1_T5 (SEQ ID NO:560) and R11723_PEA.sub.--1_T6(SEQ ID NO:561). Table 32 below describes the starting and ending position of this segment on each transcript. TABLE-US-00986 TABLE 32 Segment location on transcripts Segment Segment Transcript name starting position ending position R11723_PEA_1_T15 (SEQ 987 1010 ID NO: 556) R11723_PEA_1_T5 (SEQ ID 1905 1928 NO: 560) R11723_PEA_1_T6 (SEQ ID 1939 1962 NO: 561)

Segment cluster R11723_PEA.sub.--1_node.sub.--29 (SEQ ID NO:580) according to the present invention is supported by 69 libraries. The number of libraries was determined as previously described. This segment can be found in the following transcript(s): R11723_PEA.sub.--1_T15 (SEQ ID NO:556), R11723_PEA.sub.--1_T5 (SEQ ID NO:560) and R11723_PEA.sub.--1_T6 (SEQ ID NO:561). Table 33 below describes the starting and ending position of this segment on each transcript. TABLE-US-00987 TABLE 33 Segment location on transcripts Segment Segment Transcript name starting position ending position R11723_PEA_1_T15 (SEQ 1011 1038 ID NO: 556) R11723_PEA_1_T5 (SEQ ID 1929 1956 NO: 560) R11723_PEA_1_T6 (SEQ ID 1963 1990 NO: 561)

Segment cluster R11723_PEA.sub.--1_node.sub.--3 (SEQ ID NO:581) according to the present invention can be found in the following transcript(s): R11723_PEA.sub.--1_T15 (SEQ ID NO:556), R11723_PEA.sub.--1_T17 (SEQ ID NO:557), R11723_PEA_T19 (SEQ ID NO:558), R11723_PEA.sub.--1_T20 (SEQ ID NO:559), R11723_PEA.sub.--1_T5 (SEQ ID NO:560) and R11723_PEA.sub.--1_T6 (SEQ ID NO:561). Table 34 below describes the starting and ending position of this segment on each transcript. TABLE-US-00988 TABLE 34 Segment location on transcripts Segment Segment Transcript name starting position ending position R11723_PEA_1_T15 (SEQ 310 319 ID NO: 556) R11723_PEA_1_T17 (SEQ 310 319 ID NO: 557) R11723_PEA_1_T19 (SEQ 310 319 ID NO: 558) R11723_PEA_1_T20 (SEQ 310 319 ID NO: 559) R11723_PEA_1_T5 (SEQ ID 310 319 NO: 560) R11723_PEA_1_T6 (SEQ ID 310 319 NO: 561)

Segment cluster R11723_PEA.sub.--1_node.sub.--30 (SEQ ID NO:582) according to the present invention can be found in the following transcript(s): R11723_PEA.sub.--1_T15 (SEQ ID NO:556), R11723_PEA.sub.--1_T5 (SEQ ID NO:560) and R11723_PEA.sub.--1_T6 (SEQ ID NO:561). Table 35 below describes the starting and ending position of this segment on each transcript. TABLE-US- 00989 TABLE 35 Segment location on transcripts Segment Segment Transcript name starting position ending position R11723_PEA_1_T15 (SEQ 1039 1059 ID NO: 556) R11723_PEA_1_T5 (SEQ ID 1957 1977 NO: 560) R11723_PEA_1_T6 (SEQ ID 1991 2011 NO: 561)

Segment cluster R11723_PEA.sub.--1_node.sub.--4 (SEQ ID NO:583) according to the present invention is supported by 25 libraries. The number of libraries was determined as previously described. This segment can be found in the following transcript(s): R11723_PEA.sub.--1_T15 (SEQ ID NO:556), R11723_PEA.sub.--1_T17 (SEQ ID NO:557), R11723_PEA.sub.--1_T19 (SEQ ID NO:558), R11723_PEA.sub.--1_T20 (SEQ ID NO:559), R11723_PEA.sub.--1_T5 (SEQ ID NO:560) and R11723_PEA.sub.--1_T6 (SEQ ID NO:561). Table 36 below describes the starting and ending position of this segment on each transcript. TABLE-US-00990 TABLE 36 Segment location on transcripts Segment Segment Transcript name starting position ending position R11723_PEA_1_T15 (SEQ 320 371 ID NO: 556) R11723_PEA_1_T17 (SEQ 320 371 ID NO: 557) R11723_PEA_1_T19 (SEQ 320 371 ID NO: 558) R11723_PEA_1_T20 (SEQ 320 371 ID NO: 559) R11723_PEA_1_T5 (SEQ ID 320 371 NO: 560) R11723_PEA_1_T6 (SEQ ID 320 371 NO: 561)

Segment cluster R11723_PEA.sub.--1_node.sub.--5 (SEQ ID NO:584) according to the present invention is supported by 26 libraries. The number of libraries was determined as previously described. This segment can be found in the following transcript(s): R11723_PEA.sub.--1_T15 (SEQ ID NO:556), R11723_PEA.sub.--1_T17 (SEQ ID NO:557), R11723_PEA.sub.--1_T19 (SEQ ID NO:558), R11723_PEA.sub.--1_T20 (SEQ ID NO:559), R11723_PEA.sub.--1_T5 (SEQ ID NO:560) and R11723_PEA.sub.--1_T6 (SEQ ID NO:561). Table 37 below describes the starting and ending position of this segment on each transcript. TABLE-US-00991 TABLE 37 Segment location on transcripts Segment Segment Transcript name starting position ending position R11723_PEA_1_T15 (SEQ 372 414 ID NO: 556) R11723_PEA_1_T17 (SEQ 372 414 ID NO: 557) R11723_PEA_1_T19 (SEQ 372 414 ID NO: 558) R11723_PEA_1_T20 (SEQ 372 414 ID NO: 559) R11723_PEA_1_T5 (SEQ ID 372 414 NO: 560) R11723_PEA_1_T6 (SEQ ID 372 414 NO: 561)

Segment cluster R11723_PEA.sub.--1_node.sub.--6 (SEQ ID NO:585) according to the present invention is supported by 27 libraries. The number of libraries was determined as previously described. This segment can be found in the following transcript(s): R11723_PEA.sub.--1_T15 (SEQ ID NO:556), R11723_PEA.sub.--1_T17 (SEQ ID NO:557), R11723_PEA.sub.--1_T19 (SEQ ID NO:558), R11723_PEA.sub.--1_T20 (SEQ ID NO:559), R11723_PEA.sub.--1_T5 (SEQ ID NO:560) and R11723_PEA.sub.--1_T6 (SEQ ID NO:561). Table 38 below describes the starting and ending position of this segment on each transcript. TABLE-US-00992 TABLE 38 Segment location on transcripts Segment Segment Transcript name starting position ending position R11723_PEA_1_T15 (SEQ 415 446 ID NO: 556) R11723_PEA_1_T17 (SEQ 415 446 ID NO: 557) R11723_PEA_1_T19 (SEQ 415 446 ID NO: 558) R11723_PEA_1_T20 (SEQ 415 446 ID NO: 559) R11723_PEA_1_T5 (SEQ ID 415 446 NO: 560) R11723_PEA_1_T6 (SEQ ID 415 446 NO: 561)

Segment cluster R11723_PEA.sub.--1_node.sub.--7 (SEQ ID NO:586) according to the present invention is supported by 29 libraries. The number of libraries was determined as previously described. This segment can be found in the following transcript(s): R11723_PEA.sub.--1_T15 (SEQ ID NO:556), R11723_PEA.sub.--1_T17 (SEQ ID NO:557), R11723_PEA.sub.--1_T19 (SEQ ID NO:558), R11723_PEA.sub.--1_T20 (SEQ ID NO:559), R11723_PEA.sub.--1_T5 (SEQ ID NO:560) and R11723_PEA.sub.--1_T6 (SEQ ID NO:561). Table 39 below describes the starting and ending position of this segment on each transcript. TABLE-US-00993 TABLE 39 Segment location on transcripts Segment Segment Transcript name starting position ending position R11723_PEA_1_T15 (SEQ 447 485 ID NO: 556) R11723_PEA_1_T17 (SEQ 447 485 ID NO: 557) R11723_PEA_1_T19 (SEQ 447 485 ID NO: 558) R11723_PEA_1_T20 (SEQ 447 485 ID NO: 559) R11723_PEA_1_T5 (SEQ ID 447 485 NO: 560) R11723_PEA_1_T6 (SEQ ID 447 485 NO: 561)

Segment cluster R11723_PEA.sub.--1_node.sub.--8 (SEQ ID NO:587) according to the present invention is supported by 2 libraries. The number of libraries was determined as previously described. This segment can be found in the following transcript(s): R11723_PEA.sub.--1_T6 (SEQ ID NO:561). Table 40 below describes the starting and ending position of this segment on each transcript. TABLE-US-00994 TABLE 40 Segment location on transcripts Segment Segment Transcript name starting position ending position R11723_PEA_1_T6 (SEQ ID 486 519 NO: 561)

Variant protein alignment to the previously known protein:
Sequence name: /tmp/gp6eQTLWqk/mFtjUpUzhb:Q8IXM0

Sequence documentation:
Alignment of: R11723_PEA.sub.--1_P6 (SEQ ID NO:589).times.Q8IXM0.

Alignment segment 1/1: TABLE-US-00995 Quality: 1128.00 Escore: 0 Matching length: 112 Total length: 112 Matching Percent 100.00 Matching Percent Identity: 100.00 Similarity: Total Percent Similarity: 100.00 Total Percent Identity: 100.00 Gaps: 0

```
Alignment: TABLE-US-00996 . . . 111
MYAQALLVVGVLQRQAAAQHLHEHPPKLLRGHRVQERVDDRAEVEKRLRE  160
||||||||||||||||||||||||||||||||||||||||||||||||||  1
MYAQALLVVGVLQRQAAAQHLHEHPPKLLRGHRVQERVDDRAEVEKRLRE  50 . . . 161

GEEDHVRPEVGPRPVVLGFGRSHDPPNLVGHPAYGQCHNNQPWADTSRRE  210
||||||||||||||||||||||||||||||||||||||||||||||||||  51
GEEDHVRPEVGPRPVVLGFGRSHDPPNLVGHPAYGQCHNNQPWADTSRRE  100 . . . 211

RQRKEKHSMRTQ                                        222
||||||||||||                                        101
RQRKEKHSMRTQ                                        112
```

Sequence name: /tmp/gp6eQTLWqk/mFtjUpUzhb: Q96AC2 (SEQ ID NO: 886)

Sequence documentation:

Alignment of: R11723_PEA.sub.--1_P6 (SEQ ID NO:589).times.Q96AC2 (SEQ ID NO: 886).

Alignment segment 1/1: TABLE-US-00997 Quality: 835.00 Escore: 0 Matching length: 83 Total length: 83 Matching Percent 100.00 Matching Percent Identity: 100.00 Similarity: Total Percent Similarity: 100.00 Total Percent Identity: 100.00 Gaps: 0

```
Alignment: TABLE-US-00998 . . . 1
MWVLGIAATFCGLFLLPGFALQIQCYQCEEFQLNNDCSSPEFIVNCTVNV  50
|||||||||||||||||||||||||||||||||||||||||||||||||  1
MWVLGIAATFCGLFLLPGFALQIQCYQCEEFQLNNDCSSPEFIVNCTVNV  50

QDMCQKEVMEQSAGIMYRKSCASSAACLIASAG                  83
|||||||||||||||||||||||||||||||||                  51
QDMCQKEVMEQSAGIMYRKSCASSAACLIASAG                  83
```

Sequence name: /tmp/gp6eQTLWqk/mFtjUpUzhb: Q8N2G4

Sequence documentation:

Alignment of: R11723_PEA.sub.--1_P6 (SEQ ID NO:589).times.Q8N2G4.

Alignment segment 1/1: TABLE-US-00999 Quality: 835.00 Escore: 0 Matching length: 83 Total length: 83 Matching Percent 100.00 Matching Percent Identity: 100.00 Similarity: Total Percent Similarity: 100.00 Total Percent Identity: 100.00 Gaps: 0

```
Alignment: TABLE-US-01000 . . . 1
MWVLGIAATFCGLFLLPGFALQIQCYQCEEFQLNNDCSSPEFIVNCTVNV  50
|||||| |||||||||||||||||||||||||||||||||||||||||||  1
MWVLGTAATFCGLFLLPGFALQIQCYQCEEFQLNNDCSSPEFIVNCTVNV  50

QDMCQKEVMEQSAGIMYRKSCASSAACLIASAG                  83
|||||||||||||||||||||||||||||||||                  51
QDMCQKEVMEQSAGIMYRKSCASSAACLIASAG                  83
```

Sequence name: /tmp/gp6eQTLWqk/mFtjUpUzhb: BAC85518

Sequence documentation:
Alignment of: R11723_PEA.sub.--1_P6 (SEQ ID NO:589).times.BAC85518.

Alignment segment 1/1: TABLE-US-01001 Quality: 835.00 Escore: 0 Matching length: 83 Total length: 83 Matching Percent 100.00 Matching Percent Identity: 100.00 Similarity: Total Percent Similarity: 100.00 Total Percent Identity: 100.00 Gaps: 0

```
Alignment: TABLE-US-01002 . . . 1
MWVLGIAATFCGLFLLPGFALQIQCYQCEEFQLNNDCSSPEFIVNCTVNV  50
|||||||||||||||||||||||||||||||||||||||||||||||||  24
MWVLGIAATFCGLFLLPGFALQIQCYQCEEFQLNNDCSSPEFIVNCTVNV  73 . . . 51

QDMCQKEVMEQSAGIMYRKSCASSAACLIASAG                  83
|||||||||||||||||||||||||||||||||                  74
QDMCQKEVMEQSAGIMYRKSCASSAACLIASAG                  106
```

Sequence name: /tmp/VXjdFlzdBX/bexTxTh0Th: Q96AC2 (SEQ ID NO: 886)

Sequence documentation:

Alignment of: R11723_PEA.sub.--1_P7 (SEQ ID NO:590).times.Q96AC2 (SEQ ID NO: 886).

Alignment segment 1/1: TABLE-US-01003 Quality: 654.00 Escore: 0 Matching length: 64 Total length: 64 Matching Percent 100.00 Matching Percent Identity: 100.00 Similarity: Total Percent Similarity: 100.00 Total Percent Identity: 100.00 Gaps: 0

```
Alignment: TABLE-US-01004 1
MWVLGIAATFCGLFLLPGFALQIQCYQCEEFQLNNDCSSPEFIVNCTVNV  50
||||||||||||||||||||||||||||||||||||||||||||||||||
                                                   1
MWVLGIAATFCGLFLLPGFALQIQCYQCEEFQLNNDCSSPEFIVNCTVNV  50 51

QDMCQKEVMEQSAG                                     64
||||||||||||||
                                                   51
QDMCQKEVMEQSAG                                     64
```

Sequence name: /tmp/VXjdFlzdBX/bexTxTh0Th: Q8N2G4

Sequence documentation:

Alignment of: R11723_PEA.sub.--1_P7 (SEQ ID NO:590).times.Q8N2G4.

Alignment segment 1/1: TABLE-US-01005 Quality: 654.00 Escore: 0 Matching length: 64 Total length: 64 Matching Percent 100.00 Matching Percent Identity: 100.00 Similarity: Total Percent Similarity: 100.00 Total Percent Identity: 100.00 Gaps: 0

```
Alignment: TABLE-US-01006 1
MWVLGIAATFCGLFLLPGFALQIQCYQCEEFQLNNDCSSPEFIVNCTVNV  50
||||||||||||||||||||||||||||||||||||||||||||||||||
                                                   1
MWVLGIAATFCGLFLLPGFALQIQCYQCEEFQLNNDCSSPEFIVNCTVNV  50 51

QDMCQKEVMEQSAG                                     64
||||||||||||||
                                                   51
QDMCQKEVMEQSAG                                     64
```

Sequence name: /tmp/VXjdFlzdBX/bexTxTh0Th: BAC85273

Sequence documentation:

Alignment of: R11723_PEA.sub.--1_P7 (SEQ ID NO:590).times.BAC85273.

Alignment segment 1/1: TABLE-US-01007 Quality: 600.00 Escore: 0 Matching length: 59 Total length: 59 Matching Percent 100.00 Matching Percent Identity: 100.00 Similarity: Total Percent Similarity: 100.00 Total Percent Identity: 100.00 Gaps: 0

Sequence name: /tmp/VXjdFlzdBX/bexTxTh0Th: BAC85518

Sequence documentation:

Alignment of: R11723_PEA.sub.--1_P7 (SEQ ID NO:590).times.BAC85518.

Alignment segment 1/1: TABLE-US-01009 Quality: 654.00 Escore: 0 Matching length: 64 Total length: 64 Matching Percent 100.00 Matching Percent Identity: 100.00 Similarity: Total Percent Similarity: 100.00 Total Percent Identity: 100.00 Gaps: 0

```
Alignment: TABLE-US-01008 6
IAATFCGLFLLPGFALQIQCYQCEEFQLNNDCSSPEFIVNCTVNVQDMCQ  55
|||||||||||||||||||||||||||||||||||||||||||||||||
                                                   22
IAATFCGLFLLPGFALQIQCYQCEEFQLNNDCSSPEFIVNCTVNVQDMCQ  71 56

KEVMEQSAG                                          64
|||||||||
                                                   72
KEVMEQSAG                                          80
```

```
Alignment: TABLE-US-01010 1
MWVLGIAATFCGLFLLPGFALQIQCYQCEEFQLNNDCSSPEFIVNCTVNV  50
||||||||||||||||||||||||||||||||||||||||||||||||||
                                                   24
MWVLGIAATFCGLFLLPGFALQIQCYQCEEFQLNNDCSSPEFIVNCTVNV  73 51

QDMCQKEVMEQSAG                                     64
||||||||||||||
                                                   74
QDMCQKEVMEQSAG                                     87
```

Sequence name: /tmp/OLMSexEmlh/pc7Z7Xm1YR: Q96AC2 (SEQ ID NO: 886)

Sequence documentation:

Alignment of: R11723_PEA.sub.--1_P10 (SEQ ID NO:592).times.Q96AC2 (SEQ ID NO: 886).
Alignment segment 1/1: TABLE-US-01011 Quality: 645.00 Escore: 0 Matching length: 63 Total length: 63 Matching Percent 100.00 Matching Percent Identity: 100.00 Similarity: Total Percent Similarity: 100.00 Total Percent Identity: 100.00 Gaps: 0

```
Alignment: TABLE-US-01012 1
MWVLGIAATFCGLFLLPGFALQIQCYQCEEFQLNNDCSSPEFIVNCTVNV     50
||||||||||||||||||||||||||||||||||||||||||||||||||     1
MWVLGIAATFCGLFLLPGFALQIQCYQCEEFQLNNDCSSPEFIVNCTVNV     50  51

QDMCQKEVMEQSA                                          63
|||||||||||||                                          51
QDMCQKEVMEQSA                                          63
```

Sequence name: /tmp/OLMSexEmlh/pc7Z7Xm1YR: Q8N2G4

Sequence documentation:

Alignment of: R11723_PEA.sub.--1_P10 (SEQ ID NO:592).times.Q8N2G4.
Alignment segment 1/1: TABLE-US-01013 Quality: 645.00 Escore: 0 Matching length: 63 Total length: 63 Matching Percent 100.00 Matching Percent Identity: 100.00 Similarity: Total Percent Similarity: 100.00 Total Percent Identity: 100.00 Gaps: 0

```
Alignment: TABLE-US-01014 1
MWVLGIAATFCGLFLLPGFALQIQCYQCEEFQLNNDCSSPEFIVNCTVNV     50
||||||||||||||||||||||||||||||||||||||||||||||||||     1
MWVLGIAATFCGLFLLPGFALQIQCYQCEEFQLNNDCSSPEFIVNCTVNV     50  51

QDMCQKEVMEQSA                                          63
|||||||||||||                                          51
QDMCQKEVMEQSA                                          63
```

Sequence name: /tmp/OLMSexEmlh/pc7Z7Xm1YR: BAC85273

Sequence documentation:
Alignment of: R11723_PEA.sub.--1_P10 (SEQ ID NO:592).times.BAC85273.
Alignment segment 1/1: TABLE-US-01015 Quality: 591.00 Escore: 0 Matching length: 58 Total length: 58 Matching Percent 100.00 Matching Percent Identity: 100.00 Similarity: Total Percent Similarity: 100.00 Total Percent Identity: 100.00 Gaps: 0

```
Alignment: TABLE-US-01016 . . . 6
IAATFCGLFLLPGFALQIQCYQCEEFQLNNDCSSPEFIVNCTVNVQDMCQ     55
|||||||||||||||||||||||||||||||||||||||||||||||||     22
IAATFCGLFLLPGFALQIQCYQCEEFQLNNDCSSPEFIVNCTVNVQDMCQ     71  56

KEVMEQSA                                               63
||||||||                                               72
KEVMEQSA                                               79
```

Sequence name: /tmp/OLMSexEmlh/pc7Z7Xm1YR: BAC85518.

Alignment documentation:
Alignment of: R11723_PEA.sub.--1_P10 (SEQ ID NO:592).times.BAC85518.
Alignment segment 1/1: TABLE-US-01017 Quality: 645.00 Escore: 0 Matching length: 63 Total length: 63 Matching Percent 100.00 Matching Percent Identity: 100.00 Similarity: Total Percent Similarity: 100.00 Total Percent Identity: 100.00 Gaps: 0

```
Alignment: TABLE-US-01018 1
MWVLGIAATFCGLFLLPGFALQIQCYQCEEFQLNNDCSSPEFIVNCTVNV  50
||||||||||||||||||||||||||||||||||||||||||||||||||  24
MWVLGIAATFCGLFLLPGFALQIQCYQCEEFQLNNDCSSPEFIVNCTVNV  73 51

QDMCQKEVMEQSA  63
|||||||||||||  74
QDMCQKEVMEQSA  86
```

Alignment of: R11723_PEA.sub.--1.sub.--P13 (SEQ ID NO:591).times.Q96AC2 (SEQ ID NO: 886).

Alignment segment 1/1: TABLE-US-01019 Quality: 645.00 Escore: 0 Matching length: 63 Total length: 63 Matching Percent 100.00 Matching Percent Identity: 100.00 Similarity: Total Percent Similarity: 100.00 Total Percent Identity: 100.00 Gaps: 0

```
Alignment: TABLE-US-01020 1
MWVLGIAATFCGLFLLPGFALQIQCYQCEEFQLNNDCSSPEFIVNCTVNV  50
||||||||||||||||||||||||||||||||||||||||||||||||||   1
MWVLGIAATFCGLFLLPGFALQIQCYQCEEFQLNNDCSSPEFIVNCTVNV  50 51

QDMCQKEVMEQSA  63
|||||||||||||  51
QDMCQKEVMEQSA 63
```

Expression of R11723 Transcripts which are Detectable by Amplicon as Depicted in Sequence Name R11723 Seg13 (SEQ ID NO:891) in Normal and Cancerous Breast Tissues Expression of transcripts detectable by or according to seg13, R11723 seg13 amplicon(s) (SEQ ID NO:891) and R11723 seg13F (SEQ ID NO:889) and R11723 seg13R (SEQ ID NO:890) primers was measured by real time PCR. It should be noted that the variants of this cluster are variants of the hypothetical protein PSEC0181 (referred to herein as "PSEC"). In parallel the expression of four housekeeping genes PBGD (GenBank Accession No. BC019323 (SEQ ID NO:926); amplicon—PBGD-amplicon (SEQ ID NO:929)), HPRT1 (GenBank Accession No. NM.sub.--000194 (SEQ ID NO:930); amplicon—HPRT1-amplicon (SEQ ID NO:933)), and SDHA (GenBank Accession No. NM.sub.--004168 (SEQ ID NO:922); amplicon—SDHA-amplicon (SEQ ID NO:925)), G6PD (GenBank Accession No. NM.sub.--000402 (SEQ ID NO:918); G6PD-amplicon (SEQ ID NO:921)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 1, "Tissue samples in testing panel" above), to obtain a value of fold up-regulation for each sample relative to median of the normal PM samples.

Figure 39:
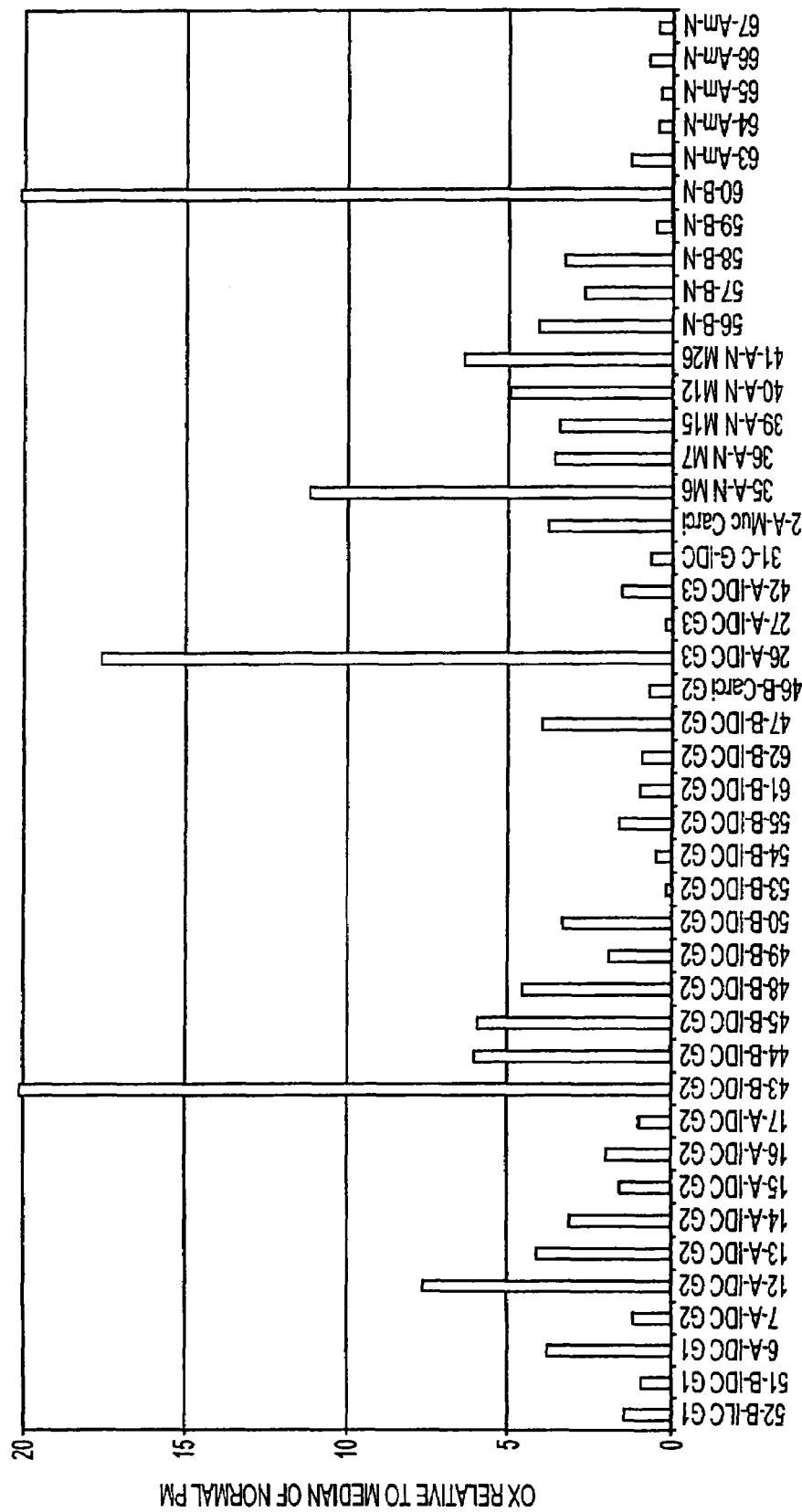
FIG. 39 is a histogram showing the expression of R11723 transcripts which are detectable by amplicon as depicted in sequence name R11723 seg13 (SEQ ID NO:891) in normal and cancerous breast tissues.

FIG. 39 is a histogram showing over expression of the above-indicated transcripts in cancerous breast samples relative to the normal samples.

As is evident from FIG. 39, the expression of transcripts detectable by the above amplicon(s) in cancer samples was higher than in the non-cancerous samples (Sample Nos. 56-60, 63-67 Table 1, Tissue samples in testing panel). Notably an over-expression of at least 5 fold was found in 5 out of 28 adenocarcinoma samples.

Primer pairs are also optionally and preferably encompassed within the present invention; for example, for the above experiment, the following primer pair was used as a non-limiting illustrative example only of a suitable primer pair: R11723 seg13F forward primer (SEQ ID NO:889); and R11723 seg13R reverse primer (SEQ ID NO:890).

The present invention also preferably encompasses any amplicon obtained through the use of any suitable primer pair; for example, for the above experiment, the following amplicon was obtained as a non-limiting illustrative example only of a suitable amplicon: R11723 seg13 (SEQ ID NO:891). TABLE-US-01021 R11723seg13F-ACACTAAAAGAACAAACACCTTGCTC (SEQ ID NO:889) R11723seg13R-TCCTCAGAAGGCACATGAAAGA (SEQ ID NO:890) R11723seg13 amplicon: ACACTAAAAGAACAAACACCTTGCTCTTCGAGATGAGACATTTTGCCAAGCAGTTG (SEQ ID NO:891) ACCACTTAGTTCTCAAGAAGCAACTATCTCTTTCATGTGCCTTCTGAGGA Expression of R11723 Transcripts which are Detectable by Amplicon as Depicted in Sequence Name R11723Seg13 (SEQ ID NO:891) in Different Normal Tissues Expression of R11723 transcripts detectable by or according to R11723seg13 amplicon (SEQ ID NO:891) and R11723seg13F (SEQ ID NO:889) R11723seg13R (SEQ ID NO:890) was measured by real time PCR. In parallel the expression of four housekeeping genes RPL19 (GenBank Accession No. NM.sub.--000981 (SEQ ID NO:934); RPL19 amplicon (SEQ ID NO:937)), TATA box (GenBank Accession No. NM.sub.--003194 (SEQ ID NO:938); TATA amplicon (SEQ ID NO:941)), UBC (GenBank Accession No. BC000449 (SEQ ID NO:942); amplicon—Ubiquitin-amplicon (SEQ ID NO:945 ) and SDHA (GenBank Accession No. NM.sub.--004168 (SEQ ID NO:922); amplicon—SDHA-amplicon (SEQ ID NO:925)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20 Table 2 "Tissue samples in normal panel" above), to obtain a value of relative expression of each sample relative to median of the ovary samples. Primers and amplicon are as above.

Figure 40:
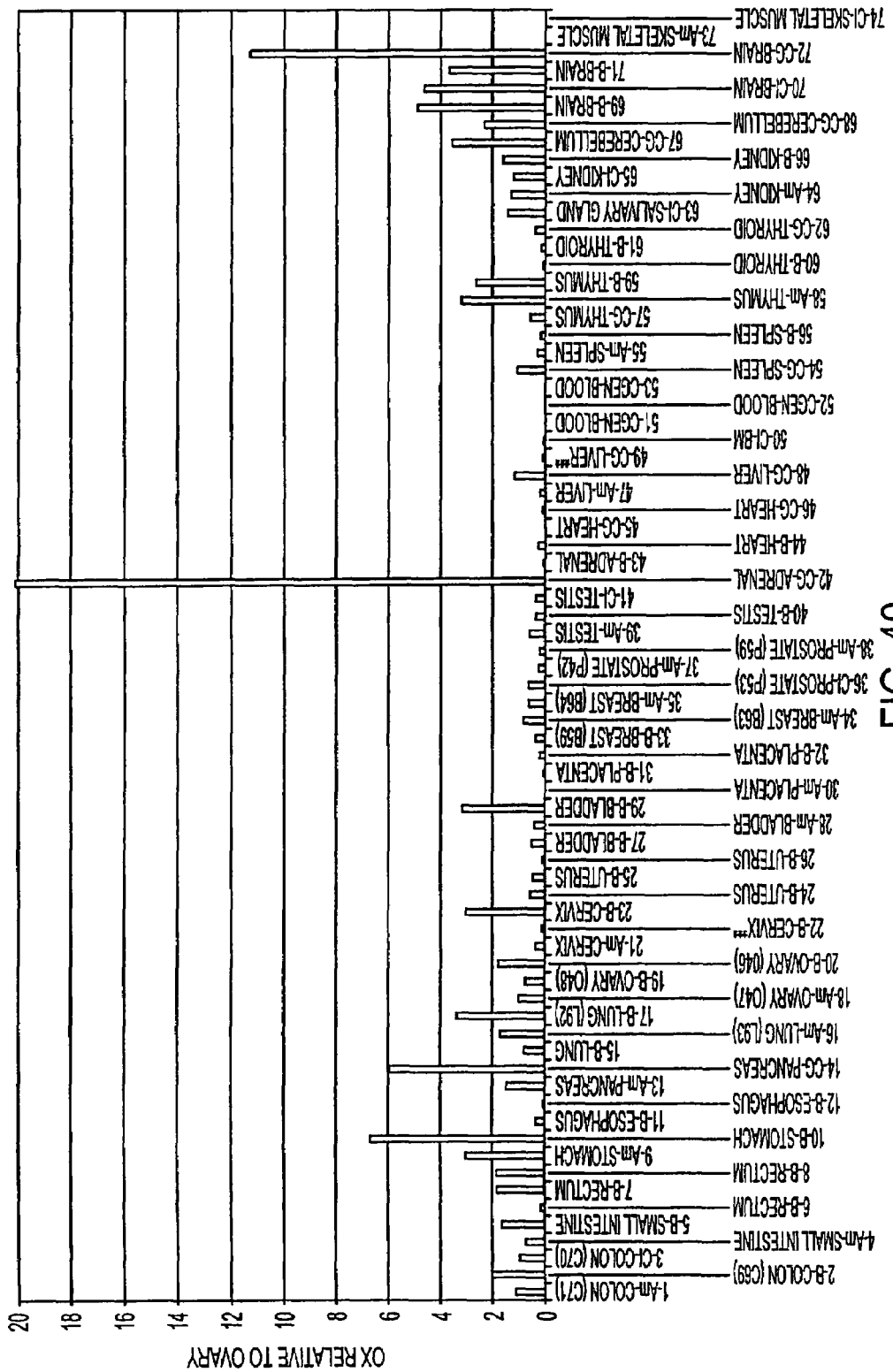
FIG. 40 is a histogram showing the expression of R11723 transcripts, which are detectable by amplicon as depicted in sequence name R11723seg13 (SEQ ID NO:891), in different normal tissues.

The results are presented in FIG. 40, demonstrating the expression of R11723 transcripts which are detectable by amplicon as depicted in sequence name R11723seg13 (SEQ ID NO:891) in different normal tissues.

Expression of R11723 Transcripts, which are Detectable by Amplicon as Depicted in Sequence Name R11723 Junc11-18 (SEQ ID NO:894) in Normal and Cancerous Breast Tissues Expression of transcripts detectable by or according to junc11-18, R11723 junc 11-18 amplicon(s) (SEQ ID NO:894) and R11723 junc11-18F (SEQ ID NO:892) and R11723 junc11-18R (SEQ ID NO:893) primers was measured by real time PCR (this junction and hence the amplicon are found in the previous known protein, also termed the "wild type" or WT protein, for which the sequence is given herein; the protein is also called "PSEC"). Use of the known protein (WT protein) for detection of breast cancer, alone or in combination with one or more variants of this cluster and/or of any other cluster and/or of any known marker, also comprises an embodiment of the present invention. In parallel the expression of four housekeeping genes PBGD (GenBank Accession No. BC019323 (SEQ ID NO:926); amplicon—PBGD-amplicon (SEQ ID NO:929)), HPRT1 (GenBank Accession No. NM.sub.--000194 (SEQ ID NO:930); amplicon—HPRT1-amplicon (SEQ ID NO:933)), SDHA (GenBank Accession No. NM.sub.--004168 (SEQ ID NO:922); amplicon—SDHA-amplicon (SEQ ID NO:925 ), and G6PD (GenBank Accession No. NM.sub.--000402 (SEQ ID NO:918); G6PD-amplicon (SEQ ID NO:921)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 1: Tissue samples in testing panel, above), to obtain a value of fold up-regulation for each sample relative to median of the normal PM samples.

Figure 41A:
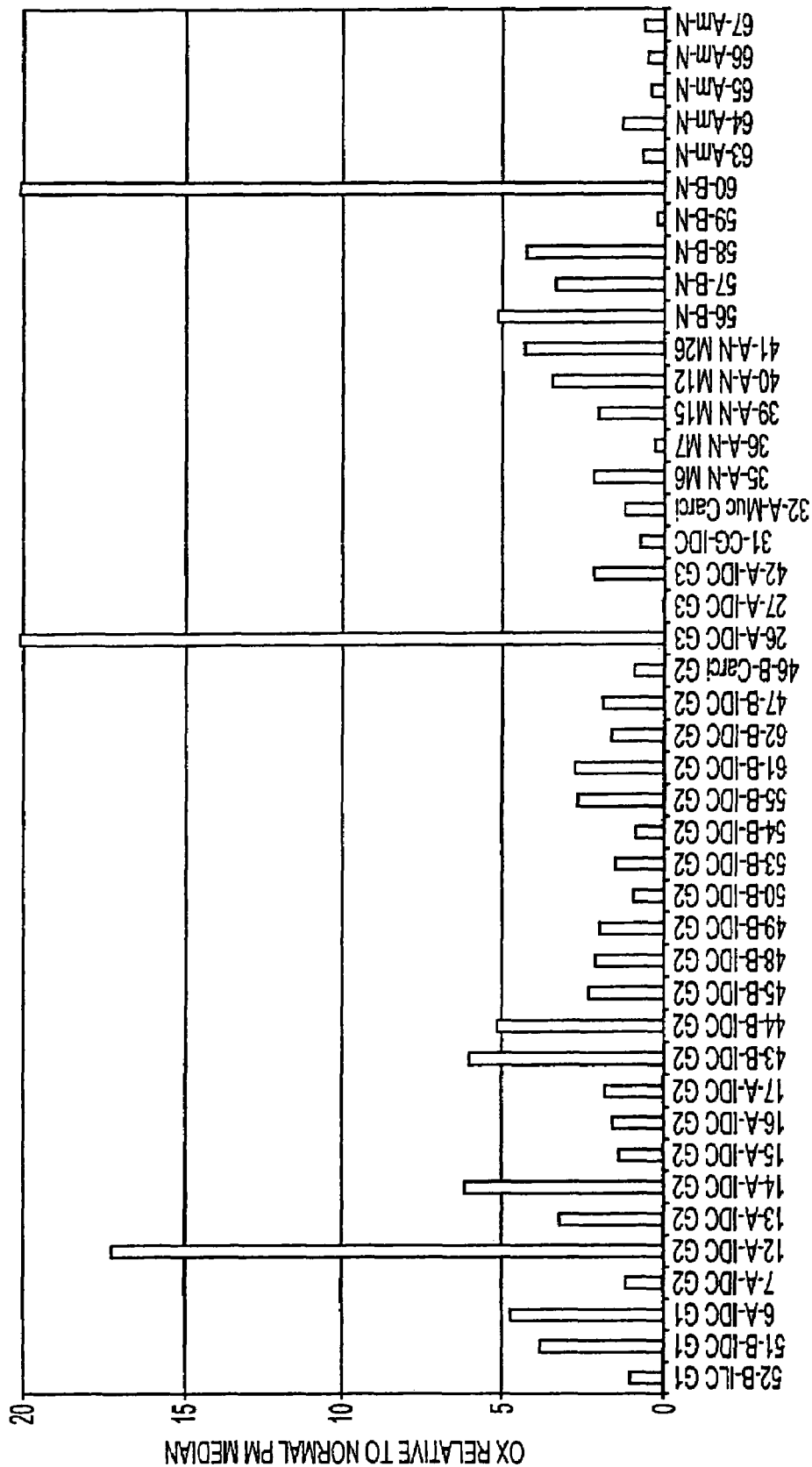
FIGS. 41A and B are histograms showing the expression of R11723 transcripts, which are detectable by amplicon as depicted in sequence name R11723 junc11-18 (SEQ ID NO:894) in normal and cancerous breast tissues (FIG. 41A) or on a panel of normal tissues (FIG. 41B).

FIG. 41A is a histogram showing over expression of the above-indicated transcripts in cancerous breast samples relative to the normal samples.

As is evident from FIG. 41A, the expression of transcripts detectable by the above amplicon in a few cancer samples was higher than in the non-cancerous samples (Sample Nos. 56-60, 63-67, Table 5: "Tissue samples in breast cancer testing panel"). Notably an over-expression of at least 5 fold was found in 5 out of 28 adenocarcinoma samples.

Primer pairs are also optionally and preferably encompassed within the present invention; for example, for the above experiment, the following primer pair was used as a non-limiting illustrative example only of a suitable primer pair: R11723 junc11-18F forward primer (SEQ ID NO:892); and R 1723 junc11-18R reverse primer (SEQ ID NO:893).

Figure 41B:
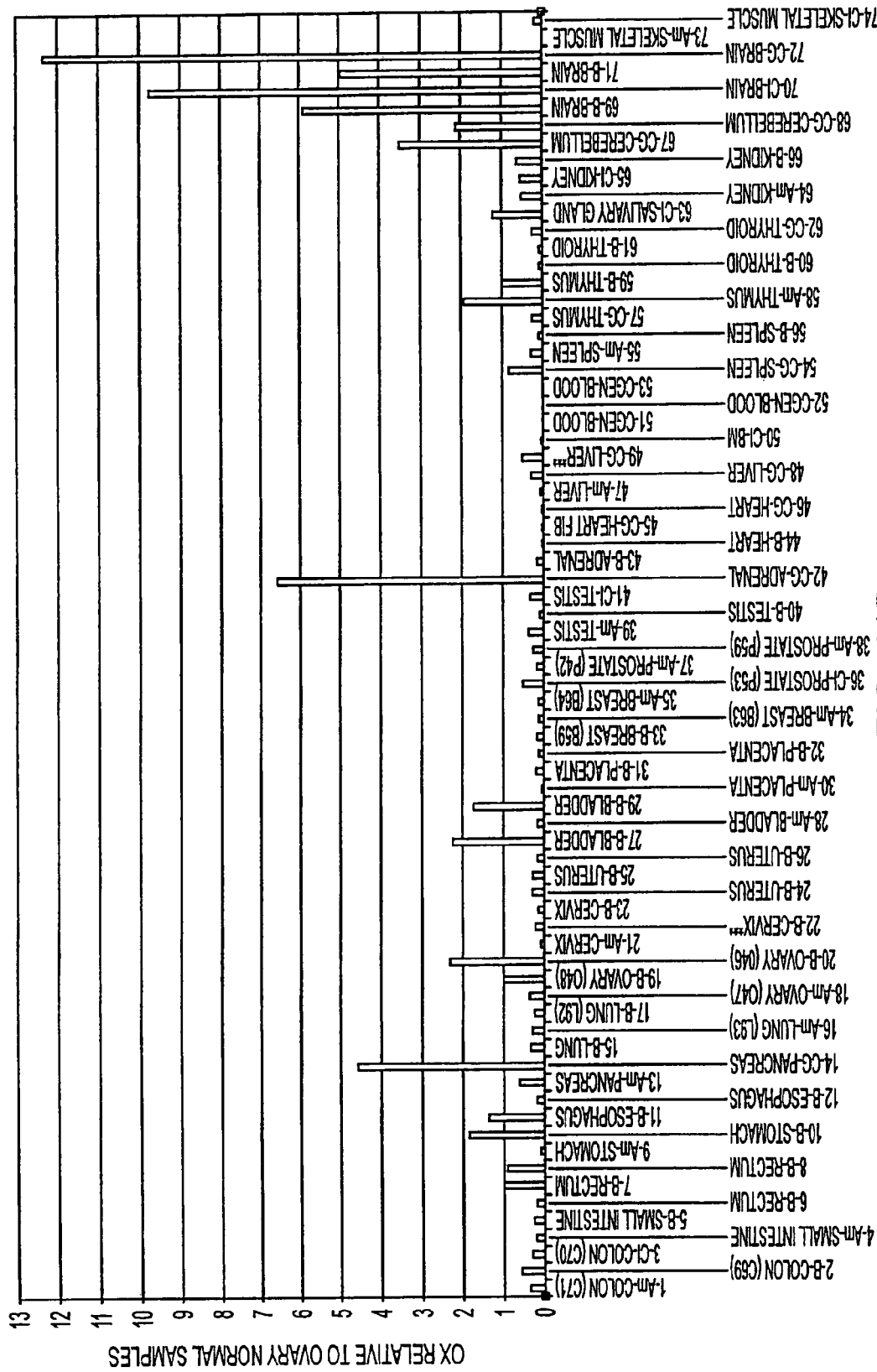

The present invention also preferably encompasses any amplicon obtained through the use of any suitable primer pair; for example, for the above experiment, the following amplicon was obtained as a non-limiting illustrative example only of a suitable amplicon: R11723 junc11-18 (SEQ ID NO:894). TABLE-US-01022 R11723junc11-18F-AGTGATGGAGCAAAGTGCCG (SEQ ID NO:892) R 1723 junc11-18R-CAGCAGCTGATGCAAACTGAG (SEQ ID NO:893) R11723 junc11 -18-AGTGATGGAGCAAAGTGCCGGGATCATGTACCGCAAGTCCTGTG-
CATCATCAGCGG (SEQ ID NO:894) CCTGTCTCATCGCCTCTGCCGGGTACCAGTCCTTCTGCTCCCC AGGGAAACTGAACT CAGTTTGCATCAGCTGCTG Expression of R11723 Transcripts, which were Detected by Amplicon as Depicted in the Sequence Name R11723 junc11-18 (SEQ ID NO:894) in Different Normal Tissues Expression of R11723 transcripts detectable by or according to R11723seg13 amplicon (SEQ ID NO:894) and R 1723 junc11-18F (SEQ ID NO:892) R 1723junc11-18R (SEQ ID NO:893) was measured by real time PCR (as described above, this junction and hence the amplicon are found in the previous known protein, also termed the "wild type" or WT protein, for which the sequence is given herein; the protein is also called "PSEC"). In parallel the expression of four housekeeping genes RPL19 (GenBank Accession No. NM.sub.--000981 (SEQ ID NO:934); RPL19 amplicon (SEQ ID NO:937)), TATA box (GenBank Accession No. NM.sub.--003194 (SEQ ID NO:938); TATA amplicon (SEQ ID NO:941)), UBC (GenBank Accession No. BC000449 (SEQ ID NO:942); amplicon—Ubiquitin-amplicon (SEQ ID NO:945)) and SDHA (GenBank Accession No. NM.sub.--004168 (SEQ ID NO:922); amplicon—SDHA-amplicon (SEQ ID NO:925)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 2: Tissue samples in normal panel, above), to obtain a value of relative expression of each sample relative to median of the ovary samples. FIG. 41B shows the level of expression of this transcript. Primers and amplicon are as for the example above.

The variant transcript expression pattern for this cluster is similar to the wild type transcript expression. However, in some cases (e.g. ovary cancer) over expression of the variant seems to be higher (for example, with regard to R11723_PEA.sub.--1.sub.--T5 (SEQ ID NO:560)).

Description for Cluster T46984

Cluster T46984 features 21 transcript(s) and 49 segment(s) of interest, the names for which are given in Tables 1 and 2, respectively, the sequences themselves are given at the end of the application. The selected protein variants are given in table 3. TABLE-US-01023 TABLE 1 Transcripts of interest Transcript Name Sequence ID No. T46984_PEA__1_T2 593 T46984_PEA__1_T3 594 T46984_PEA__1_T12 595 T46984_PEA__1_T13 596 T46984_PEA__1_T14 597 T46984_PEA__1_T15 598 T46984_PEA__1_T19 599 T46984_PEA__1_T23 600 T46984_PEA__1_T27 601 T46984_PEA__1_T32 602 T46984_PEA__1_T34 603 T46984_PEA__1_T35 604 T46984_PEA__1_T40 605 T46984_PEA__1_T42 606 T46984_PEA__1_T43 607 T46984_PEA__1_T46 608 T46984_PEA__1_T47 609 T46984_PEA__1_T48 610 T46984_PEA__1_T51 611 T46984_PEA__1_T52 612 T46984_PEA__1_T54 613

TABLE-US-01024 TABLE 2 Segments of interest Segment Name Sequence ID No. T46984_PEA__1_node__2 614 T46984_PEA__1_node__4 615 T46984_PEA__1_node__6 616 T46984_PEA__1_node__12 617 T46984_PEA__1_node__14 618 T46984_PEA__1_node__25 619 T46984_PEA__1_node__29 620 T46984_PEA__1_node__34 621 T46984_PEA__1_node__46 622 T46984_PEA__1_node__47 623 T46984_PEA__1_node__52 624 T46984_PEA__1_node__65 625 T46984_PEA__1_node__69 626 T46984_PEA__1_node__75 627 T46984_PEA__1_node__86 628 T46984_PEA__1_node__9 629 T46984_PEA__1_node__13 630 T46984_PEA__1_node__19 631 T46984_PEA__1_node__21 632 T46984_PEA__1_node__22 633 T46984_PEA__1_node__26 634 T46984_PEA__1_node__28 635 T46984_PEA__1_node__31 636 T46984_PEA__1_node__32 637 T46984_PEA__1_node__38 638 T46984_PEA__1_node__39 639 T46984_PEA__1_node__40 640 T46984_PEA__1_node__42 641 T46984_PEA__1_node__43 642 T46984_PEA__1_node__48 643 T46984_PEA__1_node__49 644 T46984_PEA__1_node__50 645 T46984_PEA__1_node__51

646 T46984_PEA_1_node_53 647 T46984_PEA_1_node_54 648 T46984_PEA_1_node_55 649 T46984_PEA_1_node_57 650 T46984_PEA_1_node_60 651 T46984_PEA_1_node_62 652 T46984_PEA_1_node_66 653 T46984_PEA_1_node_67 654 T46984_PEA_1_node_70 655 T46984_PEA_1_node_71 656 T46984_PEA_1_node_72 657 T46984_PEA_1_node_73 658 T46984_PEA_1_node_74 659 T46984_PEA_1_node_83 660 T46984_PEA_1_node_84 661 T46984_PEA_1_node_85 662

TABLE-US-01025 TABLE 3 Proteins of interest Sequence ID Protein Name No. Corresponding Transcript(s) T46984_PEA_1_P2 664 T46984_PEA_1_T2 (SEQ ID NO: 593); T46984_PEA_1_T12 (SEQ ID NO: 595); T46984_PEA_1_T23 (SEQ ID NO: 600) T46984_PEA_1_P3 665 T46984_PEA_1_T3 (SEQ ID NO: 594); T46984_PEA_1_T19 (SEQ ID NO: 599) T46984_PEA_1_P10 666 T46984_PEA_1_T13 (SEQ ID NO: 596) T46984_PEA_1_P11 667 T46984_PEA_1_T14 (SEQ ID NO: 597) T46984_PEA_1_P12 668 T46984_PEA_1_T15 (SEQ ID NO: 598) T46984_PEA_1_P21 669 T46984_PEA_1_T27 (SEQ ID NO: 601) T46984_PEA_1_P27 670 T46984_PEA_1_T34 (SEQ ID NO: 603) T46984_PEA_1_P32 671 T46984_PEA_1_T40 (SEQ ID NO: 605) T46984_PEA_1_P34 672 T46984_PEA_1_T42 (SEQ ID NO: 606) T46984_PEA_1_P35 673 T46984_PEA_1_T43 (SEQ ID NO: 607) T46984_PEA_1_P38 674 T46984_PEA_1_T47 (SEQ ID NO: 609) T46984_PEA_1_P39 675 T46984_PEA_1_T48 (SEQ ID NO: 610) T46984_PEA_1_P45 676 T46984_PEA_1_T32 (SEQ ID NO: 602) T46984_PEA_1_P46 677 T46984_PEA_1_T35 (SEQ ID NO: 604)

These sequences are variants of the known protein Dolichyl-diphosphooligosaccharide—protein glycosyltransferase 63 kDa subunit precursor (SwissProt accession identifier RIB2_HUMAN; known also according to the synonyms EC 2.4.1.119; Ribophorin II; RPN-II; RIBIIR), SEQ ID NO: 663, referred to herein as the previously known protein.

Protein Dolichyl-diphosphooligosaccharide—protein glycosyltransferase 63 kDa subunit precursor (SEQ ID NO:663) is known or believed to have the following function(s): Essential subunit of N-oligosaccharyl transferase enzyme which catalyzes the transfer of a high mannose oligosaccharide from a lipid-linked oligosaccharide donor to an asparagine residue within an Asn-X-Ser/Thr consensus motif in nascent polypeptide chains. The sequence for protein Dolichyl-diphosphooligosaccharide—protein glycosyltransferase 63 kDa subunit precursor (SEQ ID NO:663) is given at the end of the application, as "Dolichyl-diphosphooligosaccharide—protein glycosyltransferase 63 kDa subunit precursor (SEQ ID NO:663) amino acid sequence". Known polymorphisms for this sequence are as shown in Table 4. TABLE-US-01026 TABLE 4 Amino acid mutations for Known Protein SNP position(s) on amino acid sequence Comment 197 V→L 201 F→C 260 A→S 423 V→M Protein Dolichyl-diphosphooligosaccharide—protein glycosyltransferase 63 kDa subunit precursor (SEQ ID NO:663) localization is believed to be Type I membrane protein. Endoplasmic reticulum.

The following GO Annotation(s) apply to the previously known protein. The following annotation(s) were found: protein modification, which are annotation(s) related to Biological Process; oligosaccharyl transferase; dolichyl-diphosphooligosaccharide-protein glycosyltransferase; transferase, which are annotation(s) related to Molecular Function; and oligosaccharyl transferase complex; integral membrane protein, which are annotation(s) related to Cellular Component.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster T46984 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 42 refer to weighted expression of ESTs in each category, as "parts per million" (ratio of the expression of ESTs for a particular cluster to the expression of all ESTs in that category, according to parts per million).

Figure 42:
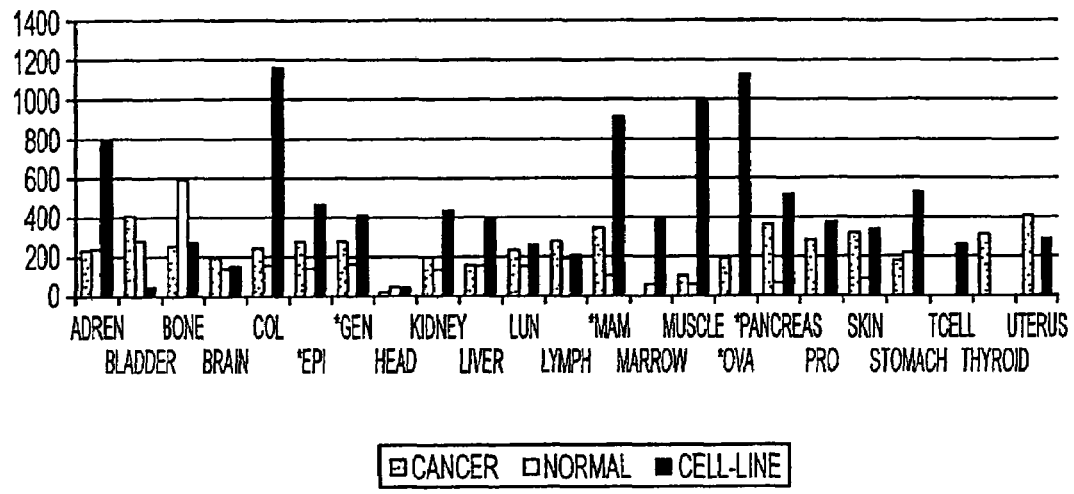
FIG. 42 is a histogram showing Cancer and cell-line vs. normal tissue expression for Cluster T46984, demonstrating overexpression in epithelial malignant tumors, a mixture of malignant tumors from different tissues, breast malignant tumors, ovarian carcinoma and pancreas carcinoma.

Overall, the following results were obtained as shown with regard to the histograms in FIG. 42 and Table 5. This cluster is overexpressed (at least at a minimum level) in the following pathological conditions: epithelial malignant tumors, a mixture of malignant tumors from different tissues, breast malignant tumors, ovarian carcinoma and pancreas carcinoma. TABLE-US-01027 TABLE 5 Normal tissue distribution Name of Tissue Number adrenal 240 bladder 287 bone 592 brain 145 colon 157 epithelial 144 general 163 head and neck 50 kidney 139 liver 156 lung 155 lymph nodes 194 breast 105 bone marrow 62 muscle 62 ovary 0 pancreas 72 prostate 201 skin 91 stomach 219 T cells 0 Thyroid 0 uterus 200

TABLE-US-01028 TABLE 6 P values and ratios for expression in cancerous tissue Name of Tissue P1 P2 SP1 R3 SP2 R4 adrenal 6.3e-01 5.4e-01 6.2e-01 0.8 2.5e-01 1.0 bladder 5.4e-01 5.9e-01 3.0e-01 1.0 6.5e-01 0.7 bone 3.9e-01 3.7e-01 9.8e-01 0.4 9.9e-01 0.4 brain 3.3e-01 2.9e-01 1.4e-01 1.2 2.0e-01 1.0 colon 8.6e-02 5.9e-02 2.6e-01 1.3 2.1e-03 1.4 epithelial 5.3e-05 6.2e-07 2.8e-08 1.9 3.4e-21 2.4 general 1.0e-04 7.3e-08 9.3e-12 1.7 8.0e-33 2.0 head and neck 4.5e-01 5.4e-01 10.8 7.5e-01 0.9 kidney 6.6e-01 6.5e-01 3.2e-01 1.2 5.3e-02 1.5 liver 5.5e-01 5.6e-01 6.5e-01 1.0 1.2e-01 1.4 lung 3.0e-01 1.7e-01 1.5e-01 1.4 6.0e-02 1.4 lymph nodes 2.9e-01 5.5e-01 2.9e-01 0.8 4.3e-01 1.0 breast 2.4e-02 5.8e-03 3.7e-02 2.2 1.7e-04 2.7 bone marrow 7.1e-01 7.5e-01 10.3 1.2e-02 1.8 muscle 5.0e-01 3.7e-01 4.7e-01 1.5 2.1e-08 1.3 ovary 1.6e-02 7.0e-03 1.5e-02 6.1 4.8e-06 7.1 pancreas 1.4e-01 5.4e-02 2.2e-05 2.9 2.4e-07 3.9 prostate 3.4e-01 1.9e-01 2.2e-01 1.2 1.4e-01 1.3 skin 3.7e-01 1.5e-01 4.2e-02 2.4 1.1e-04 1.9 stomach 6.1e-01 1.4e-01 7.3e-01 0.4 6.1e-02 1.6 T cells 1 6.7e-01 1 1.0 5.2e-01 1.8 Thyroid 4.8e-02 4.8e-02 2.0e-01 3.4 2.0e-01 3.4 uterus 2.3e-01 1.3e-01 2.2e-02 1.5 5.0e-02 1.4

As noted above, cluster T46984 features 21 transcript(s), which were listed in Table 1 above. These transcript(s) encode for protein(s) which are variant(s) of protein Dolichyl-diphosphooligosaccharide—protein glycosyltransferase 63 kDa subunit precursor (SEQ ID NO:663). A description of each variant protein according to the present invention is now provided.

Variant protein T46984_PEA.sub.--1_P2 (SEQ ID NO:664) according to the present invention has an amino acid sequence as given at the end of the application; it is encoded by transcript(s) T46984_PEA.sub.--1_T2 (SEQ ID NO:593). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P2 (SEQ ID NO:664) and RIB2_HUMAN (SEQ ID NO:663):

1. An isolated chimeric polypeptide encoding for T46984_PEA.sub.--1_P2 (SEQ ID NO:664), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFAL FFQLVDVNTGAELTPHQTFVRLHNQKT-GQEVVFVAEPDNKNVYKFELDTSERKIEFDS ASG-TYTLYLIIGDATLKNPILWNV corresponding to amino acids 1-498 of RIB2_HUMAN (SEQ ID NO:663), which also corresponds to amino acids 1-498 of T46984_PEA.sub.--1_P2 (SEQ ID NO:664), and a second amino acid sequence being at least 70%, optionally at least 80%, preferably at least 85%, more preferably at least 90% and most preferably at least 95% homologous to a polypeptide having the sequence VCA corresponding to amino acids 499-501 of T46984_PEA.sub.--1_P2 (SEQ ID NO:664), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein T46984_PEA.sub.--1_P2 (SEQ ID NO:664), as compared to the known protein Dolichyl-diphosphooligosaccharide—protein glycosyltransferase 63 kDa subunit precursor (SEQ ID NO:663), are described in Table 7 (given according to their position(s) on the amino acid sequence in the first column; the second column indicates whether the glycosylation site is present in the variant protein; and the last column indicates whether the position is different on the variant protein). TABLE-US-01029 TABLE 7 Glycosylation site(s) Position(s) on known amino Present in acid sequence variant protein? Position in variant protein? 106 yes 106

Variant protein T46984_PEA.sub.--1_P2 (SEQ ID NO:664) is encoded by the following transcript(s): T46984_PEA.sub.--1_T2 (SEQ ID NO:593), for which the sequence(s) is/are given at the end of the application. The coding portion of transcript T46984_PEA.sub.--1_T2 (SEQ ID NO:593) is shown in bold; this coding portion starts at position 316 and ends at position 1818. The transcript also has the following SNPs as listed in Table 8 (given according to their position on the nucleotide sequence, with the alternative nucleic acid listed; the last column indicates whether the SNP is known or not; the presence of known SNPs in variant protein T46984_PEA.sub.--1_P2 (SEQ ID NO:664) sequence provides support for the deduced sequence of the variant protein according to the present invention). TABLE-US-01030 TABLE 8 Nucleic acid SNPs SNP position on nucleotide Alternative sequence nucleic acid Previously known SNP? 28 G→C No 173 G→C Yes 256 C→T Yes 274 G→C Yes 325 C→No 389 C→G Yes 610 G→A Yes 718 T→No 724 C→No 844 C→T Yes 857→G No 885 C→No 897→G No 1002 G→A No 1048A→No 1048A→G No 1068A→C No 1076 G→A Yes 1187A→No 1187A→C No 1220A→G No 1220A→T No 1254T→G No 1291 A→C No 1293 C→G No 1303 G→A No 1376 G→T Yes 1588 A→C No 1618 T→No 1618 T→C No 1660 T→No 1693 A→C No 1693 A→T No 2099 G→A Yes 2124 C→G Yes 2124 C→T Yes 2133 A→G Yes 2501 C→T Yes 2617 G→T Yes 2683 C→T Yes 2741 G→A Yes 2940 T→No 3024 G→A Yes 3158 C→No 3158 C→A No 3165 C→No 3169 G→No 3354 C→A No 3374 T→C Yes 3468 C→T No 3501 A→C No 3513 A→T No 3528 G→A Yes 3534→A No 3543 A→G No 3568 T→G No 3582 T→A No 3582 T→G No 3682→C No 3691 T→No 3750 A→C No Variant protein T46984_PEA.sub.--1_P3 (SEQ ID NO:665) according to the present invention has an amino acid sequence as given at the end of the application; it is encoded by transcript(s) T46984_PEA.sub.--1_T3 (SEQ ID NO:594). An alignment is given to the known protein (Dolichyl-diphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P3 (SEQ ID NO:665) and RIB2_HUMAN (SEQ ID NO:663):

1. An isolated chimeric polypeptide encoding for T46984_PEA.sub.--1_P3 (SEQ ID NO:665), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFAL FFQLVDVNTGAELTPHQ corresponding to amino acids 1-433 of RIB2_HUMAN (SEQ ID NO:663), which also corresponds to amino acids 1-433 of T46984_PEA.sub.--1_P3 (SEQ ID NO:665), and a second amino acid sequence being at least 70%, optionally at least 80%, preferably at least 85%, more preferably at least 90% and most preferably at least 95% homologous to a polypeptide having the sequence ICHIWK-LIFLP (SEQ ID NO:947) corresponding to amino acids 434-444 of T46984_PEA.sub.--1_P3 (SEQ ID NO:665), wherein said first amino acid sequence and second amino acid sequence are contiguous and in a sequential order.

2. An isolated polypeptide encoding for a tail of T46984_PEA.sub.--1_P3 (SEQ ID NO:665), comprising a polypeptide being at least 70%, optionally at least about 80%, preferably at least about 85%, more preferably at least about 90% and most preferably at least about 95% homologous to the sequence ICHIWKLIFLP (SEQ ID NO:947) in T46984_PEA.sub.--1_P3 (SEQ ID NO:665).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA.sub.--1_P3 (SEQ ID NO:665) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein T46984_PEA.sub.--1_P3 (SEQ ID NO:665) sequence provides support for the deduced sequence of this variant protein according to the present invention). TABLE-US-01031 TABLE 9 Amino acid mutations SNP position(s) on amino acid Alternative sequence amino acid(s) Previously known SNP? 4 P→No 25 P→R Yes 99 G→R Yes 135 F→No 137 L→No 190→No 245 N→No 245 N→D No 251 E→D No 254 S→N Yes 291 Q→No 291 Q→P No 302 Q→R No 302 Q→L No 326 T→P No 330 D→N No 354 G→V Yes 425 T→P No The glycosylation sites of variant protein T46984_PEA.sub.--1_P3 (SEQ ID NO:665), as compared to the known protein Dolichyl-diphosphooligosaccharide—protein glycosyltransferase 63 kDa subunit precursor (SEQ ID NO:663), are described in Table 10 (given according to their position(s) on the amino acid sequence in the first column; the second column indicates whether the glycosylation site is present in the variant protein; and the last column indicates whether the position is different on the variant protein). TABLE-US-01032 TABLE 10 Glycosylation site(s) Position(s) on known amino Present in acid sequence variant protein? Position in variant protein? 106 yes 106

Variant protein T46984_PEA.sub.--1_P3 (SEQ ID NO:665) is encoded by the following transcript(s): T46984_PEA.sub.--1_T3 (SEQ ID NO:594), for which the sequence(s) is/are given at the end of the application. The coding portion of transcript T46984_PEA.sub.--1_T3 (SEQ ID NO:594) is shown in bold; this coding portion starts at position 316 and ends at position 1647. The transcript also has the following SNPs as listed in Table 11 (given according to their position on the nucleotide sequence, with the alternative nucleic acid listed; the last column indicates whether the SNP is known or not; the presence of known SNPs in variant protein T46984_PEA.sub.--1_P3 (SEQ ID NO:665) sequence provides support for the deduced sequence of this variant protein according to the present invention). TABLE-US-01033 TABLE 11 Nucleic acid SNPs SNP position on nucleotide Alternative sequence nucleic acid Previously known SNP? 28 G→C No 173 G→C Yes 256 C→T Yes 274 G→C Yes 325 C→No 389 C→G Yes 610 G→A Yes 718 T→No 724 C→No 844 C→T Yes 857→G No 885 C→No 897→G No 1002 G→A No 1048 A→No 1048 A→G No 1068A→C No 1076 G→A Yes 1187A→No 1187 A→C No 1220 A→G No 1220A→T No 1254 T→G No 1291 A→C No 1293 C→G No 1303 G→A No 1376 G→T Yes 1588 A→C No 1784 C→T Yes 1959 G→A Yes 2112 G→A Yes 2137 C→G Yes 2246 T→No 2246 T→C No 2288 T→No 2321 A→C No 2321 A→T No 2552 C→No 2552 C→A No 2559 C→No 2563 G→No 2748 C→A No 2768 T→C Yes 2862 C→T No 2895 A→C No 2907 A→T No 2922 G→A Yes 2928→A No 2937 A→G No 2962 T→G No 2976 T→A No 2976 T→G No 3076→C No 3085 T→No 3144 A→C No Variant protein T46984_PEA.sub.--1_P10 (SEQ ID NO:666) according to the present invention has an amino acid sequence as given at the end of the application; it is encoded by transcript(s) T46984_PEA.sub.--1_T13 (SEQ ID NO:596). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P10 (SEQ ID NO:666) and RIB2_HUMAN SEQ ID NO:663):

1. An isolated chimeric polypeptide encoding for T46984_PEA.sub.--1_P10 (SEQ ID NO:666), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFAL FFQLVDVNTGAELTPHQTFVRLHNQKT-GQEVVFVAEPDNKNVYKFELDTSERKIEFDS ASG-TYTLYLIIGDATLKNPILWNV corresponding to amino acids 1-498 of RIB2_HUMAN (SEQ ID NO:663), which also corresponds to amino acids 1-498 of T46984_PEA.sub.--1_P10 (SEQ ID NO:666), and a second amino acid sequence being at least 70%, optionally at least 80%, preferably at least 85%, more preferably at least 90% and most preferably at least 95% homologous to a polypeptide having the sequence LMDQK (SEQ ID NO:948) corresponding to amino acids 499-503 of T46984_PEA.sub.--1_P10 (SEQ ID NO:666), wherein said first amino acid sequence and second amino acid sequence are contiguous and in a sequential order.

2. An isolated polypeptide encoding for a tail of T46984_PEA.sub.--1.sub.--P10 (SEQ ID NO:666), comprising a polypeptide being at least 70%, optionally at least about 80%, preferably at least about 85%, more preferably at least about 90% and most preferably at least about 95% homologous to the sequence LMDQK (SEQ ID NO:948) in T46984_PEA.sub.--1_P10 (SEQ ID NO:666)

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA.sub.--1_P10 (SEQ ID NO:666) also has the following non-silent SNPs (Single Nucleotide Polymorphisms) as listed in Table 12, (given according to their position(s) on the amino acid sequence, with the alternative amino acid(s) listed; the last column indicates whether the SNP is known or not; the presence of known SNPs in variant protein T46984_PEA.sub.--1_P10 (SEQ ID NO:666) sequence provides support for the deduced sequence of this variant protein according to the present invention). TABLE-US-01034 TABLE 12 Amino acid mutations SNP position(s) on Alternative Previously amino acid sequence amino acid(s) known SNP? 4 P→No 25 P→R Yes 99 G→R Yes 135 F→No 137 L→No 190 R→No 245 N→No 245 N→D No 251 E→D No 254 S→N Yes 291 Q→No 291 Q→P No 302 Q→R No 302 Q→L No 326 T→P No 330 D→N No 354 G→V Yes 425 T→P No 435 F→No 435 F→L No 449 F→No 460 K→* No 460 K→Q No The glycosylation sites of variant protein T46984_PEA.sub.--1_P10 (SEQ ID NO:666), as compared to the known protein Dolichyl-diphosphooligosaccharide—protein glycosyltransferase 63 kDa subunit precursor (SEQ ID NO:663), are described in Table 13 (given according to their position(s) on the amino acid sequence in the first column; the second column indicates whether the glycosylation site is present in the variant protein; and the last column indicates whether the position is different on the variant protein). TABLE-US-01035 TABLE 13 Glycosylation site(s) Position(s) on known Present in Position in amino acid sequence variant protein? variant protein? 106 yes 106

Variant protein T46984_PEA.sub.--1_P10 (SEQ ID NO:666) is encoded by the following transcript(s): T46984_PEA.sub.--1_T13 (SEQ ID NO:596), for which the sequence(s) is/are given at the end of the application. The coding portion of transcript T46984_PEA.sub.--1_T13 (SEQ ID NO:596) is shown in bold; this coding portion starts at position 316 and ends at position 1824. The transcript also has the following SNPs as listed in Table 14 (given according to their position on the nucleotide sequence, with the alternative nucleic acid listed; the last column indicates whether the SNP is known or not; the presence of known SNPs in variant protein T46984_PEA.sub.--1_P10 (SEQ ID NO:666) sequence provides support for the deduced sequence of this variant protein according to the present invention). TABLE-US-01036 TABLE 14 Nucleic acid SNPs SNP position on Alternative Previously nucleotide sequence nucleic acid known SNP? 28 G→C No 173 G→C Yes 256 C→T Yes 274 G→C Yes 325 C→No 389 C→G Yes 610 G→A Yes 718 T→No 724 C→No 844 C→T Yes 857→G No 885→C→No 897→G No 1002 G→A No 1048A→No 1048A→G No 1068A→C No 1076 G→A Yes 1187 A→No 1187 A→C No 1220 A→G No 1220 A→T No 1254 T→G No 1291 A→C No 1293 C→G No 1303 G→A No 1376 G→T Yes 1588 A→C No 1618 T→No 1618 T→C No 1660 T→No 1693 A→C No 1693 A→T No 1845 T→No 1983 C→No 1983 C→A No 1990 C→No 1994 G→No 2179 C→A No 2199 T→C Yes 2293 C→T No 2326 A→C No 2338 A→T No 2353 G→A Yes 2359→A No 2368 A→G No 2393 T→G No 2407 T→A No 2407 T→G No 2507→C No 2516 T→No 2575 A→C No Variant protein T46984_PEA.sub.--1_P11 (SEQ ID NO:667) according to the present invention has an amino acid sequence as given at the end of the application; it is encoded by transcript(s) T46984_PEA.sub.--1_T14 (SEQ ID NO:597). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P11 (SEQ ID NO:667) and RIB2_HUMAN SEQ ID NO:663):

1. An isolated chimeric polypeptide encoding for T46984_PEA.sub.--1_P11 (SEQ ID NO:667), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFAL FFQLVDVNTGAELTPHQTFVRLHNQKT-GQEVVFVAEPDNKNVYKFELDTSERKIEFDS ASG-TYTLYLIIGDATLKNPILWNVADVVIKF-PEEEAPSTVLSQNLFTPKQEIQHLFREPEK RPPTVVSNTFTALILSPLLLLFAL-WIRIGANVSNFTFAPSTIIFHLGHAAMLGLMYVYWT QLNMFQTLKYLAILGSVTFLAGNRMLAQQAVKR corresponding to amino acids 1-628 of RIB2_HUMAN (SEQ ID NO:663), which also corresponds to amino acids 1-628 of T46984_PEA.sub.--1_P11 (SEQ ID NO:667).

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein T46984_PEA.sub.--1_P11 (SEQ ID NO:667) also has the following non-silent SNPs (Single Nucleotide Polymorphisms) as listed in Table 15, (given according to their position(s) on the amino acid sequence, with the alternative amino acid(s) listed; the last column indicates whether the SNP is known or not; the presence of known SNPs in variant protein T46984_PEA.sub.--1_P11 (SEQ ID NO:667) sequence provides support for the deduced sequence of this variant protein according to the present invention). TABLE-US-01037 TABLE 15 Amino acid mutations SNP position(s) on Alternative Previously amino acid sequence amino acid(s) known SNP? 4 P→No 25 P→R Yes 99 G→R Yes 135 F→No 137 L→No 190 R→No 245 N→No 245 N→D No 251 E→D No 254 S→N Yes 291 Q→P No 291 Q→No 302 Q→L No 302 Q→R No 326 T→P No 330 D→N No 354 G→V Yes 425 T→P No 435 F→No 435 F→L No 449 F→No 460 K→Q No 460 K→* No 537 P→T No 537 P→No 539 T→No 540 V→No 602 T→N No The glycosylation sites of variant protein T46984_PEA.sub.--1_P11 (SEQ ID NO:667), as compared to the known protein Dolichyl-diphosphooligosaccharide—protein glycosyltransferase 63 kDa subunit precursor (SEQ ID NO:663), are described in Table 16 (given according to their position(s) on the amino acid sequence in the first column; the second column indicates whether the glycosylation site is present in the variant protein; and the last column indicates whether the position is different on the variant protein). TABLE-US-01038 TABLE 16 Glycosylation site(s)

Position(s) on known Present in Position in amino acid sequence variant protein? variant protein? 106 yes 106

Variant protein T46984_PEA.sub.--1_P11 (SEQ ID NO:667) is encoded by the following transcript(s): T46984_PEA.sub.--1_T14 (SEQ ID NO:597), for which the sequence(s) is/are given at the end of the application. The coding portion of transcript T46984_PEA.sub.--1_T14 (SEQ ID NO:597) is shown in bold; this coding portion starts at position 316 and ends at position 2199. The transcript also has the following SNPs as listed in Table 17 (given according to their position on the nucleotide sequence, with the alternative nucleic acid listed; the last column indicates whether the SNP is known or not; the presence of known SNPs in variant protein T46984_PEA.sub.--1_P11 (SEQ ID NO:667) sequence provides support for the deduced sequence of this variant protein according to the present invention). TABLE-US-01039 TABLE 17 Nucleic acid SNPs SNP position on Alternative Previously nucleotide sequence nucleic acid known SNP? 28 G→C No 173 G→C Yes 256 C→T Yes 274 G→C Yes 325 C→No 389 C→G Yes 610 G→A Yes 718 T→No 724 C→No 844 C→T Yes 857→G No 885 C→No 897→G No 1002 G→A No 1048 A→No 1048 A→G No 1068 A→C No 1076 G→A Yes 1187 A→No 1187 A→C No 1220 A→G No 1220 A→T No 1254 T→G No 1291 A→C No 1293 C→G No 1303 G→A No 1376 G→T Yes 1588 A→C No 1618 T→No 1618 T→C No 1660 T→No 1693 A→C No 1693 A→T No 1924 C→No 1924 C→A No 1931 C→No 1935 G→No 2120 C→A No 2140 T→C Yes 2449 A→Yes 2537 C→T Yes 2614 C→T Yes 2699 C→T Yes 2857 G→A Yes 2879 A→G Yes 3078 A→G Yes 3354 G→A Yes Variant protein T46984_PEA.sub.--1_P12 (SEQ ID NO:668) according to the present invention has an amino acid sequence as given at the end of the application; it is encoded by transcript(s) T46984_PEA.sub.--1_T15 (SEQ ID NO:598). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P12 (SEQ ID NO:668) and RIB2_HUMAN (SEQ ID NO:663):

1. An isolated chimeric polypeptide encoding for T46984_PEA.sub.--1_P12 (SEQ ID NO:668), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMN corresponding to amino acids 1-338 of RIB2_HUMAN (SEQ ID NO:663), which also corresponds to amino acids 1-338 of T46984_PEA.sub.--1_P12 (SEQ ID NO:668), and a second amino acid sequence being at least 70%, optionally at least 80%, preferably at least 85%, more preferably at least 90% and most preferably at least 95% homologous to a polypeptide having the sequence SQDLH (SEQ ID NO:949) corresponding to amino acids 339-343 of T46984_PEA.sub.--1_P12 (SEQ ID NO:668), wherein said first amino acid sequence and second amino acid sequence are contiguous and in a sequential order.

2. An isolated polypeptide encoding for a tail of T46984_PEA.sub.--1_P12 (SEQ ID NO:668), comprising a polypeptide being at least 70%, optionally at least about 80%, preferably at least about 85%, more preferably at least about 90% and most preferably at least about 95% homologous to the sequence SQDLH (SEQ ID NO:949) in T46984_PEA.sub.--1_P12 (SEQ ID NO:668).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA.sub.--1_P12 (SEQ ID NO:668) also has the following non-silent SNPs (Single Nucleotide Polymorphisms) as listed in Table 18, (given according to their position(s) on the amino acid sequence, with the alternative amino acid(s) listed; the last column indicates whether the SNP is known or not; the presence of known SNPs in variant protein T46984_PEA.sub.--1_P12 (SEQ ID NO:668) sequence provides support for the deduced sequence of this variant protein according to the present invention). TABLE-US-01040 TABLE 18 Amino acid mutations SNP position(s) on Alternative Previously amino acid sequence amino acid(s) known SNP? 4 P→No 25 P→R Yes 99 G→R Yes 135 F→No 137 L→No 190 R→No 245 N→No 245 N→D No 251 E→D No 254 S→N Yes 291 Q→No 291 Q→P No 302 Q→L No 302 Q→R No 326 T→P No 330 D→N No The glycosylation sites of variant protein T46984_PEA.sub.--1_P12 (SEQ ID NO:668), as compared to the known protein Dolichyl-diphosphooligosaccharide—protein glycosyltransferase 63 kDa subunit precursor (SEQ ID NO:663), are described in Table 19 (given according to their position(s) on the amino acid sequence in the first column; the second column indicates whether the glycosylation site is present in the variant protein; and the last column indicates whether the position is different on the variant protein). TABLE-US-01041 TABLE 19 Glycosylation site(s) Position(s) on known Present in Position in amino acid sequence variant protein? variant protein? 106 yes 106

Variant protein T46984_PEA.sub.--1_P12 (SEQ ID NO:668) is encoded by the following transcript(s): T46984_PEA.sub.--1_T15 (SEQ ID NO:598), for which the sequence(s) is/are given at the end of the application. The coding portion of transcript T46984_PEA.sub.--1_T15 (SEQ ID NO:598) is shown in bold; this coding portion starts at position 316 and ends at position 1344. The transcript also has the following SNPs as listed in Table 20 (given according to their position on the nucleotide sequence, with the alternative nucleic acid listed; the last column indicates whether the SNP is known or not; the presence of known SNPs in variant protein T46984_PEA.sub.--1_P12 (SEQ ID NO:668) sequence provides support for the deduced sequence of this variant protein according to the present invention). TABLE-US-01042 TABLE 20 Nucleic acid SNPs SNP position on Alternative Previously nucleotide sequence nucleic acid known SNP? 28 G→C No 173 G→C Yes 256 C→T Yes 274 G→C Yes 325 C→No 389 C→G Yes 610 G→A Yes 718 T→No 724 C→No 844 C→T Yes 857→G No 885 C→No 897→G No 1002 G→A No 1048A→No 1048A→G No 1068 A→C No 1076 G→A Yes 1187 A→No 1187 A→C No 1220 A→G No 1220 A→T No 1254 T→G No 1291 A→C No 1293 C→G No 1303 G→A No 1505 A→C No 1535 T→No 1535 T→C No 1577 T→No 1610 A→C No 1610 A→T No 1841 C→No 1841 C→A No 1848 C→No 1852 G→No 2037 C→A No 2057 T→C Yes 2151 C→T No 2184 A→C No 2196 A→T No 2211 G→A Yes 2217→A No 2226 A→G No 2251 T→G No 2265 T→A No 2265 T→G No 2365→C No 2374 T→No 2433 A→C No Variant protein T46984_PEA.sub.--1_P21 (SEQ ID NO:669) according to the present invention has an amino acid sequence as given at the end of the application; it is encoded by transcript(s) T46984_PEA.sub.--1_T27 (SEQ ID NO:601). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P21 (SEQ ID NO:669) and RIB2_HUMAN (SEQ ID NO:663):

1. An isolated chimeric polypeptide encoding for T46984_PEA.sub.--1_P21 (SEQ ID NO:669), comprising a first amino acid sequence being at least 70%, optionally at least 80%, preferably at least 85%, more preferably at least 90% and most preferably at least 95% homologous to a polypeptide having the sequence M corresponding to amino acids 1-1 of T46984_PEA.sub.--1_P21 (SEQ ID NO:669), and a second amino acid sequence being at least 90% homologous to KACTYIRSNLDPSNVDSLFYAAQASQALSGCEISISNETKDLLLAAVSEDSSVTQIYHAV AALSGFGLPLASQEALSALTARLSKEETVLATVQALQTASHLSQQADLRSIVEEIEDLVA RLDELGGVYLQFEEGLETTALFVAATYKLMDHVGTEPSIKEDQVIQLMNAIFSKKNFES LSEAFSVASAAAVLSHNRYHVPWVVPEGSASDTHEQAILRLQ VTNVLSQPLTQATVKL EHAKSVASRATVLQKTSFTPVGDVFELNFMNVKFSSGYYDFLVEVEGDNRYIANTVEL RVKISTEVGITNVDLSTVDKDQSIAPKTTRVTYPAKAKGTFIADSHQNFALFFQLV DVNT GAELTPHQTFVRLHNQKTGQEVVFVAEPDNKNVYKFELDTSERKIEFDSASGTYTLYLII GDATLKNPILWNVADVVIKFPEEEAPSTVLSQNLFTPKQEIQHLFREPEKRPPTVVSNTF TALILSPLLLLFALWIRIGANVSNFTFAPSTIIFHLGHAAMLGLMYVYWTQLNMFQTLKY LAILGSVTFLAGNRMLAQQAVKRTAH corresponding to amino acids 70-631 of RIB2_HUMAN (SEQ ID NO:663), which also corresponds to amino acids 2-563 of T46984_PEA.sub.--1_P21 (SEQ ID NO:669), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: membrane. The protein localization is believed to be membrane because both trans-membrane region prediction programs predicted a trans-membrane region for this protein. In addition both signal-peptide prediction programs predict that this protein is a non-secreted protein.

Variant protein T46984_PEA.sub.--1_P21 (SEQ ID NO:669) also has the following non-silent SNPs (Single Nucleotide Polymorphisms) as listed in Table 21, (given according to their position(s) on the amino acid sequence, with the alternative amino acid(s) listed; the last column indicates whether the SNP is known or not; the presence of known SNPs in variant protein T46984_PEA.sub.--1_P21 (SEQ ID NO:669) sequence provides support for the deduced sequence of this variant protein according to the present invention). TABLE-US-01043 TABLE 21 Amino acid mutations SNP position(s) on Alternative Previously amino acid sequence amino acid(s) known SNP? 31 G→R Yes 67 F→No 69 L→No 122 R→No 177 N→No 177 N→D No 183 E→D No 186 S→N Yes 223 Q→P No 223 Q→No 234 Q→L No 234 Q→R No 258 T→P No 262 D→N No 286 G→V Yes 357 T→P No 367 F→L No 367 F→No 381 F→No 392 K→* No 392 K→Q No 469 P→No 469 P→T No 471 T→No 472 V→No 534→N No The glycosylation sites of variant protein T46984_PEA.sub.--1_P21 (SEQ ID NO:669), as compared to the known protein Dolichyl-diphosphooligosaccharide—protein glycosyltransferase 63 kDa subunit precursor (SEQ ID NO:663), are described in Table 22 (given according to their position(s) on the amino acid sequence in the first column; the second column indicates whether the glycosylation site is present in the variant protein; and the last column indicates whether the position is different on the variant protein). TABLE-US-01044 TABLE 22 Glycosylation site(s) Position(s) on known Present in Position in amino acid sequence variant protein? variant protein? 106 yes 38

Variant protein T46984_PEA.sub.--1_P21 (SEQ ID NO:669) is encoded by the following transcript(s): T46984_PEA.sub.--1_T27 (SEQ ID NO:601), for which the sequence(s) is/are given at the end of the application. The coding portion of transcript T46984_PEA.sub.--1_T27 (SEQ ID NO:601) is shown in bold; this coding portion starts at position 338 and ends at position 2026. The transcript also has the following SNPs as listed in Table 23 (given according to their position on the nucleotide sequence, with the alternative nucleic acid listed; the last column indicates whether the SNP is known or not; the presence of known SNPs in variant protein T46984_PEA.sub.--1_P21 (SEQ ID NO:669) sequence provides support for the deduced sequence of this variant protein according to the present invention). TABLE-US-01045 TABLE 23 Nucleic acid SNPs SNP position on Alternative Previously nucleotide sequence nucleic acid known SNP? 68 C→T Yes 194 A→G Yes 428 G→A Yes 536 T→No 542 C→No 662 C→T Yes 675→G No 703 C→No 715→G No 820 G→A No 866 A→No 866 A→G No 886 A→C No 894 G→A Yes 1005 A→No 1005 A→C No 1038 A→G No 1038 A→T No 1072 T→G No 1109 A→C No 1111 C→G No 1121 G→A No 1194 G→T Yes 1406 A→C No 1436 T→No 1436 T→C No 1478 T→No 1511 A→C No 1511 A→T No 1742 C→No 1742 C→A No 1749 C→No 1753 G→No 1938 C→A No 1958 T→C Yes 2052 C→T No 2085 A→C No 2097 A→T No 2112 G→A Yes 2118→A No 2127 A→G No 2152 T→G No 2166 T→A No 2166 T→G No 2266→C No 2275 T→No 2334 A→C No Variant protein T46984_PEA.sub.--1_P27 (SEQ ID NO:670) according to the present invention has an amino acid sequence as given at the end of the application; it is encoded by transcript(s) T46984_PEA.sub.--1_T34 (SEQ ID NO:603). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P27 (SEQ ID NO:670) and RIB2_HUMAN (SEQ ID NO:663):

1. An isolated chimeric polypeptide encoding for T46984_PEA.sub.--1_P27 (SEQ ID NO:670) comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVELRVKISTEVGITNVDLSTVD-KDQSIAPKTTRVTYPAKAKGTFIADSHQNFA corresponding to amino acids 1-415 of RIB2_HUMAN (SEQ ID NO:663), which also corresponds to amino acids 1-415 of T46984_PEA.sub.--1_P27 (SEQ ID NO:670), and a second amino acid sequence being at least 70%, optionally at least 80%, preferably at least 85%, more preferably at least 90% and most preferably at least 95% homologous to a polypeptide having the sequence FGSGLVPMSPTSLLLLARLY-FTWDMLLCWDSCMSTGLSSTCSRP (SEQ ID NO:950) corresponding to amino acids 416-459 of T46984_PEA.sub.--1_P27 (SEQ ID NO:670), wherein said first amino acid sequence and second amino acid sequence are contiguous and in a sequential order.

2. An isolated polypeptide encoding for a tail of T46984_PEA.sub.--1_P27 (SEQ ID NO:670), comprising a polypeptide being at least 70%, optionally at least about 80%, preferably at least about 85%, more preferably at least about 90% and most preferably at least about 95% homologous to the sequence FGSGLVPMSPTSLLLLARLYFTWDM-LLCWDSCMSTGLSSTCSRP (SEQ ID NO:950) in T46984_PEA.sub.--1_P27 (SEQ ID NO:670).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA.sub.--1_P27 (SEQ ID NO:670) also has the following non-silent SNPs (Single Nucleotide Polymorphisms) as listed in Table 24, (given according to their position(s) on the amino acid sequence, with the alternative amino acid(s) listed; the last column indicates whether the SNP is known or not; the presence of known SNPs in variant protein T46984_PEA.sub.--1_P27 (SEQ ID NO:670) sequence provides support for the deduced sequence of this variant protein according to the present invention). TABLE-US-01046 TABLE 24 Amino acid mutations SNP position(s) on Alternative Previously amino acid sequence amino acid(s) known SNP? 4 P→No 25 P→R Yes 99 G→R Yes 135 F→No 137 L→No 190 R→No 245 N→No 245 N→D No 251 E→D No 254 S→N Yes 291 Q→No 291 Q→P No 302 Q→R No 302 Q→L No 326 T→P No 330 D→N No 354 G→V Yes 459 P→T No The glycosylation sites of variant protein T46984_PEA.sub.--1_P27 (SEQ ID NO:670), as compared to the known protein Dolichyl-diphosphooligosaccharide—protein glycosyltransferase 63 kDa subunit precursor (SEQ ID NO:663), are described in Table 25 (given according to their position(s) on the amino acid sequence in the first column; the second column indicates whether the glycosylation site is present in the variant protein; and the last column indicates whether the position is different on the variant protein). TABLE-US-01047 TABLE 25 Glycosylation site(s) Position(s) on known Present in Position in amino acid sequence variant protein? variant protein? 106 yes 106

Variant protein T46984_PEA.sub.--1_P27 (SEQ ID NO:670) is encoded by the following transcript(s): T46984_PEA.sub.--1_T34 (SEQ ID NO:603), for which the sequence(s) is/are given at the end of the application. The coding portion of transcript T46984_PEA.sub.--1_T34 (SEQ ID NO:603) is shown in bold; this coding portion starts at position 316 and ends at position 1692. The transcript also has the following SNPs as listed in Table 26 (given according to their position on the nucleotide sequence, with the alternative nucleic acid listed; the last column indicates whether the SNP is known or not; the presence of known SNPs in variant protein T46984_PEA.sub.--1_P27 (SEQ ID NO:670) sequence provides support for the deduced sequence of this variant protein according to the present invention). TABLE-US-01048 TABLE 26 Nucleic acid SNPs SNP position on Alternative Previously nucleotide sequence nucleic acid known SNP? 28 G→C No 173 G→C Yes 256 C→T Yes 274 G→C Yes 325 C→No 389 C→G Yes 610 G→A Yes 718 T→No 724 C→No 844 C→T Yes 857→G No 885 C→No 897→G No 1002 G→A No 1048 A→No 1048A→G No 1068 A→C No 1076 G→A Yes 1187 A→No 1187A→C No 1220A→G No 1220A→T No 1254 T→G No 1291 A→C No 1293 C→G No 1303 G→A No 1376 G→T Yes 1690 C→A No 1710 T→C Yes 1804 C→T No 1837 A→C No 1849 A→T No 1864 G→A Yes 1870→A No 1879 A→G No 1904 T→G No 1918 T→A No 1918 T→G No 2018→C No 2027 T→No 2086 A→C No Variant protein T46984_PEA.sub.--1_P32 (SEQ ID NO:671) according to the present invention has an amino acid sequence as given at the end of the application; it is encoded by transcript(s) T46984_PEA.sub.--1_T40 (SEQ ID NO:605). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P32 (SEQ ID NO:671) and RIB2_HUMAN (SEQ ID NO:663):

1. An isolated chimeric polypeptide encoding for T46984_PEA.sub.--1_P32 (SEQ ID NO:671), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY- HVPVVVVPEGSASDTHEQAILRLQVTNVLSQ PLTQATVKLEHAKSVASRATVLQKTSFT-PVGDVFELNFMNVKFSSGYYDFLVEVEGDN RYIANTVE corresponding to amino acids 1-364 of RIB2_HUMAN (SEQ ID NO:663), which also corresponds to amino acids 1-364 of T46984_PEA.sub.--1_P32 (SEQ ID NO:671), and a second amino acid sequence being at least 70%, optionally at least 80%, preferably at least 85%, more preferably at least 90% and most preferably at least 95% homologous to a polypeptide having the sequence GQVR-WLTPVIPALWEAKAGGSPEVRSSILAWPT (SEQ ID NO:95 1) corresponding to amino acids 365-397 of T46984_PEA.sub.--1_P32 (SEQ ID NO:671), wherein said first amino acid sequence and second amino acid sequence are contiguous and in a sequential order.

2. An isolated polypeptide encoding for a tail of T46984_PEA.sub.--1_P32 (SEQ ID NO:671), comprising a polypeptide being at least 70%, optionally at least about 80%, preferably at least about 85%, more preferably at least about 90% and most preferably at least about 95% homologous to the sequence GQVRWLTPVIPALWEAKAGGSPEVRSSI-LAWPT (SEQ ID NO:951) in T46984_PEA.sub.--1_P32 (SEQ ID NO:671).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA.sub.--1_P32 (SEQ ID NO:671) also has the following non-silent SNPs (Single Nucleotide Polymorphisms) as listed in Table 27, (given according to their position(s) on the amino acid sequence, with the alternative amino acid(s) listed; the last column indicates whether the SNP is known or not; the presence of known SNPs in variant protein T46984_PEA.sub.--1_P32 (SEQ ID NO:671) sequence provides support for the deduced sequence of this variant protein according to the present invention). TABLE-US-01049 TABLE 27 Amino acid mutations SNP position(s) on Alternative Previously amino acid sequence amino acid(s) known SNP? 4 P→No 25 P→R Yes 99 G→R Yes 135 F→No 137 L→No 190 R→No 245 N→No 245 N→D No 251 E→D No 254 S→N Yes 291 Q→No 291 Q→P No 302 Q→R No 302 Q→L No 326 T→P No 330 D→N No 354 G→V Yes The glycosylation sites of variant protein T46984_PEA.sub.--1_P32 (SEQ ID NO:671), as compared to the known protein Dolichyl-diphosphooligosaccharide—protein glycosyltransferase 63 kDa subunit precursor (SEQ ID NO:663), are described in Table 28 (given according to their position(s) on the amino acid sequence in the first column; the second column indicates whether the glycosylation site is present in the variant protein; and the last column indicates whether the position is different on the variant protein). TABLE-US-01050 TABLE 28 Glycosylation site(s) Position(s) on known Present in Position in amino acid sequence variant protein? variant protein? 106 yes 106

Variant protein T46984_PEA.sub.--1_P32 (SEQ ID NO:671) is encoded by the following transcript(s): T46984_PEA.sub.--1_T40 (SEQ ID NO:605), for which the sequence(s) is/are given at the end of the application. The coding portion of transcript T46984_PEA.sub.--1_T40 (SEQ ID NO:605) is shown in bold; this coding portion starts at position 316 and ends at position 1506. The transcript also has the following SNPs as listed in Table 29 (given according to their position on the nucleotide sequence, with the alternative nucleic acid listed; the last column indicates whether the SNP is known or not; the presence of known SNPs in variant protein T46984_PEA.sub.--1_P32 (SEQ ID NO:671) sequence provides support for the deduced sequence of this variant protein according to the present invention). TABLE-US-01051 TABLE 29 Nucleic acid SNPs SNP position on Alternative Previously nucleotide sequence nucleic acid known SNP? 28 G→C No 173 G→C Yes 256 C→T Yes 274 G→C Yes 325 C→No 389 C→G Yes 610 G→A Yes 718 T→No 724 C→No 844 C→T Yes 857→G No 885 C→No 897→G No 1002 G→A No 1048A→No 1048A→G No 1068A→C No 1076 G→A Yes 1187 A→No 1187A→C No 1220A→G No 1220A→T No 1254 T→G No 1291 A→C No 1293 C→G No 1303 G→A No 1376 G→T Yes Variant protein T46984_PEA.sub.--1_P34 (SEQ ID NO:672) according to the present invention has an amino acid sequence as given at the end of the application; it is encoded by transcript(s) T46984_PEA.sub.--1_T42 (SEQ ID NO:606). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P34 (SEQ ID NO:672) and RIB2_HUMAN (SEQ ID NO:663):

1. An isolated chimeric polypeptide encoding for T46984_PEA.sub.--1_P34 (SEQ ID NO:672), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAILRLQVTNVLSQ PLTQATVKLEHAKSVASRATVLQKTSFTPVG corresponding to amino acids 1-329 of RIB2_HUMAN (SEQ ID NO:663), which also corresponds to amino acids 1-329 of T46984_PEA.sub.--1_P34 (SEQ ID NO:672).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA.sub.--1_P34 (SEQ ID NO:672) also has the following non-silent SNPs (Single Nucleotide Polymorphisms) as listed in Table 30, (given according to their position(s) on the amino acid sequence, with the alternative amino acid(s) listed; the last column indicates whether the SNP is known or not; the presence of known SNPs in variant protein T46984_PEA.sub.--1_P34 (SEQ ID NO:672) sequence provides support for the deduced sequence of this variant protein according to the present invention). TABLE-US-01052 TABLE 30 Amino acid mutations SNP position(s) on Alternative Previously amino acid sequence amino acid(s) known SNP? 4 P→No 25 P→R Yes 99 G→R Yes 135 F→No 137 L→No 190 R→No 245 N→No 245 N→D No 251 E→D No 254 S→N Yes 291 Q→No 291 Q→P No 302 Q→L No 302 Q→R No 326 T→P No The glycosylation sites of variant protein T46984_PEA.sub.--1_P34 (SEQ ID NO:672), as compared to the known protein Dolichyl-diphosphooligosaccharide—protein glycosyltransferase 63 kDa subunit precursor (SEQ ID NO:663), are described in Table 31 (given according to their position(s) on the amino acid sequence in the first column; the second column indicates whether the glycosylation site is present in the variant protein; and the last column indicates whether the position is different on the variant protein). TABLE-US-01053 TABLE 31 Glycosylation site(s) Position(s) on known Present in Position in amino acid sequence variant protein? variant protein? 106 yes 106

Variant protein T46984_PEA.sub.--1_P34 (SEQ ID NO:672) is encoded by the following transcript(s): T46984_PEA.sub.--1_T42 (SEQ ID NO:606), for which the sequence(s) is/are given at the end of the application. The coding portion of transcript T46984_PEA.sub.--1_T42 (SEQ ID NO:606) is shown in bold; this coding portion starts at position 316 and ends at position 1302. The transcript also has the following SNPs as listed in Table 32 (given according to their position on the nucleotide sequence, with the alternative nucleic acid listed; the last column indicates whether the SNP is known or not; the presence of known SNPs in variant protein T46984_PEA.sub.--1_P34 (SEQ ID NO:672) sequence provides support for the deduced sequence of this variant protein according to the present invention). TABLE-US-01054 TABLE 32 Nucleic acid SNPs SNP position on Alternative Previously nucleotide sequence nucleic acid known SNP? 28 G→C No 173 G→C Yes 256 C→T Yes 274 G→C Yes 325 C→No 389 C→G Yes 610 G→A Yes 718 T→No 724 C→No 844 C→T Yes 857→G No C→No 897→G No 1002 G→A No 1048 A→No 1048 A→G No 1068 A→C No 1076 G→A Yes 1187 A→No 1187 A→C No 1220 A→G No 1220 A→T No 1254 T→G No 1291 A→C No 1293 C→G No 1324 T→C Yes 1489 G→A Yes Variant protein T46984_PEA.sub.--1_P35 (SEQ ID NO:673) according to the present invention has an amino acid sequence as given at the end of the application; it is encoded by transcript(s) T46984_PEA.sub.--1_T43 (SEQ ID NO:607). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P35 (SEQ ID NO:673) and RIB2_HUMAN (SEQ ID NO:663):

1. An isolated chimeric polypeptide encoding for T46984_PEA.sub.--1_P35 (SEQ ID NO:673), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL-TARLSKEETVLATVQALQTASHLSQQADLRSI VEE-IEDLVARLDELGGVYLQFEEGLET-TALFVAATYKLMDHVGTEPSIKEDQVIQLMNA IFSKKNFESLSEAFSVASAAAVLSHNRY-HVPVVVVPEGSASDTHEQAI corresponding to amino acids 1-287 of RIB2_HUMAN (SEQ ID NO:663), which also corresponds to amino acids 1-287 of T46984_PEA.sub.--1_P35 (SEQ ID NO:673), and a second amino acid sequence being at least 70%, optionally at least 80%, preferably at least 85%, more preferably at least 90% and most preferably at least 95% homologous to a polypeptide having the sequence GCWPSRQSREQHISSRRKMEILKTEC-QEKESRTIHSMRRKMEKKNFI (SEQ ID NO:952) corresponding to amino acids 288-334 of T46984_PEA.sub.--1_P35 (SEQ ID NO:673), wherein said first amino acid sequence and second amino acid sequence are contiguous and in a sequential order.

2. An isolated polypeptide encoding for a tail of T46984_PEA.sub.--1_P35 (SEQ ID NO:673), comprising a polypeptide being at least 70%, optionally at least about 80%, preferably at least about 85%, more preferably at least about 90% and most preferably at least about 95% homologous to the sequence TABLE-US-01055 GCWPSRQSREQHISSR-RKMEILKTECQEKESRTIHSMRRKMEKKNFI (SEQ ID NO:952) in T46984_PEA_1_P35. (SEQ ID NO:673)

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA.sub.--1_P35 (SEQ ID NO:673) also has the following non-silent SNPs (Single Nucleotide Polymorphisms) as listed in Table 33, (given according to their position(s) on the amino acid sequence, with the alternative amino acid(s) listed; the last column indicates whether the SNP is known or not; the presence of known SNPs in variant protein T46984_PEA.sub.--1_P35 (SEQ ID NO:673) sequence provides support for the deduced sequence of this variant protein according to the present invention). TABLE-US-01056 TABLE 33 Amino acid mutations SNP position(s) on amino acid Alternative sequence amino acid(s) Previously known SNP? 4 P→No 25 P→R Yes 99 G→R Yes 135 F→No 137 L→No 190 R→No 245 N→No 245 N→D No 251 E→D No 254 S→N Yes 320 T→P No 324 M→L No 329 E→K Yes 334 I→V No The glycosylation sites of variant protein T46984_PEA.sub.--1_P35 (SEQ ID NO:673), as compared to the known protein Dolichyl-diphosphooligosaccharide—protein glycosyltransferase 63 kDa subunit precursor (SEQ ID NO:663), are described in Table 34 (given according to their position(s) on the amino acid sequence in the first column; the second column indicates whether the glycosylation site is present in the variant protein; and the last column indicates whether the position is different on the variant protein). TABLE-US-01057 TABLE 34 Glycosylation site(s) Position(s) on known amino Present in acid sequence variant protein? Position in variant protein? 106 yes 106

Variant protein T46984_PEA.sub.--1_P35 (SEQ ID NO:673) is encoded by the following transcript(s): T46984_PEA.sub.--1_T43 (SEQ ID NO:607), for which the sequence(s) is/are given at the end of the application. The coding portion of transcript T46984_PEA.sub.--1_T43 (SEQ ID NO:607) is shown in bold; this coding portion starts at position 316 and ends at position 1317. The transcript also has the following SNPs as listed in Table 35 (given according to their position on the nucleotide sequence, with the alternative nucleic acid listed; the last column indicates whether the SNP is known or not; the presence of known SNPs in variant protein T46984_PEA.sub.--1_P35 (SEQ ID NO:673) sequence provides support for the deduced sequence of this variant protein according to the present invention). TABLE-US-01058 TABLE 35 Nucleic acid SNPs SNP position on nucleotide Alternative sequence nucleic acid Previously known SNP? 28 G→C No 173 G→C Yes 256 C→T Yes 274 G→C Yes 325 C→No 389 C→G Yes 610 G→A Yes718 T→No 724 C→No 844 C→T Yes857→G No 885 C→No 897→G No 1002 G→A No 1048 A→No 1048 A→G No 1068A→C No 1076 G→A Yes 1240 C→T No 1273 A→C No 1285 A→T No 1300 G→A Yes 1306→A No 1315 A→G No 1340 T→G No 1354 T→A No 1354 T→G No 1454 →C No 1463 T→No 1522 A→C No Variant protein T46984_PEA.sub.--1_P38 (SEQ ID NO:674) according to the present invention has an amino acid sequence as given at the end of the application; it is encoded by transcript(s) T46984_PEA.sub.--1_T47 (SEQ ID NO:609). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P38 (SEQ ID NO:674) and RIB2_HUMAN (SEQ ID NO:663):

1. An isolated chimeric polypeptide encoding for T46984_PEA.sub.--1_P38 (SEQ ID NO:674) comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLMVSEDSS VTQIYHAVAALSGFGLPLASQEAL corresponding to amino acids 1-145 of RIB2_HUMAN (SEQ ID NO:663), which also corresponds to amino acids 1-145 of T46984_PEA.sub.--1_P38 (SEQ ID NO:674), and a second amino acid sequence being at least 70%, optionally at least 80%, preferably at least 85%, more preferably at least 90% and most preferably at least 95% homologous to a polypeptide having the sequence MDPDWCQCLQLHFCS (SEQ ID NO:953) corresponding to amino acids 146-160 of T46984_PEA.sub.--1_P38 (SEQ ID NO:674), wherein said first amino acid sequence and second amino acid sequence are contiguous and in a sequential order.

2. An isolated polypeptide encoding for a tail of T46984_PEA.sub.--1_P38 (SEQ ID NO:674), comprising a polypeptide being at least 70%, optionally at least about 80%, preferably at least about 85%, more preferably at least about 90% and most preferably at least about 95% homologous to the sequence MDPDWCQCLQLHFCS (SEQ ID NO:953) in T46984_PEA.sub.--1_P38 (SEQ ID NO:674).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA.sub.--1_P38 (SEQ ID NO:674) also has the following non-silent SNPs (Single Nucleotide Polymorphisms) as listed in Table 36, (given according to their position(s) on the amino acid sequence, with the alternative amino acid(s) listed; the last column indicates whether the SNP is known or not; the presence of known SNPs in variant protein T46984_PEA.sub.--1_P38 (SEQ ID NO:674) sequence provides support for the deduced sequence of this variant protein according to the present invention). TABLE-US-01059 TABLE 36 Amino acid mutations SNP position(s) on amino acid Alternative sequence amino acid(s) Previously known SNP? 4 P→No 25 P→R Yes 99 G→R Yes 135 F→No 137 L→No The glycosylation sites of variant protein T46984_PEA.sub.--1_P38 (SEQ ID NO:674), as compared to the known protein Dolichyl-diphosphooligosaccharide—protein glycosyltransferase 63 kDa subunit precursor (SEQ ID NO:663), are described in Table 37 (given according to their position(s) on the amino acid sequence in the first column; the second column indicates whether the glycosylation site is present in the variant protein; and the last column indicates whether the position is different on the variant protein). TABLE-US-01060 TABLE 37 Glycosylation site(s) Position(s) on known amino Present in acid sequence variant protein? Position in variant protein? 106 yes 106

Variant protein T46984_PEA.sub.--1_P38 (SEQ ID NO:674) is encoded by the following transcript(s): T46984_PEA.sub.--1_T47 (SEQ ID NO:609), for which the sequence(s) is/are given at the end of the application. The coding portion of transcript T46984_PEA.sub.--1_T47 (SEQ ID NO:609) is shown in bold; this coding portion starts at position 316 and ends at position 795. The transcript also has the following SNPs as listed in Table 38 (given according to their position on the nucleotide sequence, with the alternative nucleic acid listed; the last column indicates whether the SNP is known or not; the presence of known SNPs in variant protein T46984.sub.--PEA.sub.--1_P38 (SEQ ID NO:674) sequence provides support for the deduced sequence of this variant protein according to the present invention). TABLE-US-01061 TABLE 38 Nucleic acid SNPs SNP position on nucleotide Alternative sequence nucleic acid Previously known SNP? 28 G→C No 173 G→C Yes 256 C→T Yes 274 G→C Yes 325 C→No 389 C→G Yes 610 G→A Yes 718 T→No 724 C→No 879 C→A No 899 T→C Yes 993 C→T No 1026 A→C No 1038 A→T No 1053 G→A Yes 1059→A No 1068 A→G No 1093 T→G No 1107 T→A No 1107 T→G No 1207 →C No 1216 T→No 1275 A→C No Variant protein T46984_PEA.sub.--1_P39 (SEQ ID NO:675) according to the present invention has an amino acid sequence as given at the end of the application; it is encoded by transcript(s) T46984_PEA.sub.--1_T48 (SEQ ID NO:610). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P39 (SEQ ID NO:675) and RIB2_HUMAN (SEQ ID NO:663):

1.An isolated chimeric polypeptide encoding for T46984_PEA.sub.--1_P39 (SEQ ID NO:675), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCEISISNETKDLLLAAVSEDSS VTQIYHAVAALSGFGLPLASQEALSAL- TARLSKEETVLA corresponding to amino acids 1-160 of RIB2_HUMAN (SEQ ID NO:663), which also corresponds to amino acids 1-160 of T46984_PEA.sub.--1_P39 (SEQ ID NO:675).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA.sub.--1_P39 (SEQ ID NO:675) also has the following non-silent SNPs (Single Nucleotide Polymorphisms) as listed in Table 39, (given according to their position(s) on the amino acid sequence, with the alternative amino acid(s) listed; the last column indicates whether the SNP is known or not; the presence of known SNPs in variant protein T46984_PEA.sub.--1_P39 (SEQ ID NO:675) sequence provides support for the deduced sequence of this variant protein according to the present invention). TABLE-US-01062 TABLE 39 Amino acid mutations SNP position(s) on amino acid Alternative sequence amino acid(s) Previously known SNP? 4 P→No 25 P→R Yes 99 G→R Yes 135 F→No 137 L→No The glycosylation sites of variant protein T46984_PEA.sub.--1_P39 (SEQ ID NO:675), as compared to the known protein Dolichyl-diphosphooligosaccharide— protein glycosyltransferase 63 kDa subunit precursor (SEQ ID NO:663), are described in Table 40 (given according to their position(s) on the amino acid sequence in the first column; the second column indicates whether the glycosylation site is present in the variant protein; and the last column indicates whether the position is different on the variant protein). TABLE-US-01063 TABLE 40 Glycosylation site(s) Position(s) on known amino Present in acid sequence variant protein? Position in variant protein? 106 yes 106

Variant protein T46984_PEA.sub.--1_P39 (SEQ ID NO:675) is encoded by the following transcript(s): T46984_PEA.sub.--1_T48 (SEQ ID NO:610), for which the sequence(s) is/are given at the end of the application. The coding portion of transcript T46984_PEA.sub.--1_T48 (SEQ ID NO:610) is shown in bold; this coding portion starts at position 316 and ends at position 795. The transcript also has the following SNPs as listed in Table 41 (given according to their position on the nucleotide sequence, with the alternative nucleic acid listed; the last column indicates whether the SNP is known or not; the presence of known SNPs in variant protein T46984_PEA.sub.--1_P39 (SEQ ID NO:675) sequence provides support for the deduced sequence of this variant protein according to the present invention). TABLE-US-01064 TABLE 41 Nucleic acid SNPs SNP position on nucleotide Alternative sequence nucleic acid Previously known SNP? 28 G→C No 173 G→C Yes 256 C→T Yes 274 G→C Yes 325 C→No 389 C→G Yes 610 G→A Yes 718 T→No 724 C→No 848 G→T Yes 879 C→G Yes 1008 A→G Yes 1397 A→G Yes Variant protein T46984_PEA.sub.--1_P45 (SEQ ID NO:676) according to the present invention has an amino acid sequence as given at the end of the application; it is encoded by transcript(s) T46984_PEA.sub.--1_T32 (SEQ ID NO:602). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P45 (SEQ ID NO:676) and RIB2_HUMAN (SEQ. ID NO:663):

1. An isolated chimeric polypeptide encoding for T46984_PEA.sub.--1_P45 (SEQ ID NO:676), comprising a first amino acid sequence being at least 90% homologous to MAPPGSSTVFLLALTIIASTWALTPTH-YLTKHDVERLKASLDRPFTNLESAFYSIVGLSSL GAQVPDAKKACTYIRSNLDPSNVD-SLFYAAQASQALSGCE corresponding to amino acids 1-101 of RIB2_HUMAN (SEQ ID NO:663), which also corresponds to amino acids 1-101 of T46984_PEA.sub.--1_P45 (SEQ ID NO:676), and a second amino acid sequence being at least 70%, optionally at least 80%, preferably at least 85%, more preferably at least 90% and most preferably at least 95% homologous to a polypeptide having the sequence NSPGSADSIPPVPAG (SEQ ID NO:954) corresponding to amino acids 102-116 of T46984_PEA.sub.--1_P45 (SEQ ID NO:676), wherein said first amino acid sequence and second amino acid sequence are contiguous and in a sequential order.

2. An isolated polypeptide encoding for a tail of T46984_PEA.sub.--1_P45 (SEQ ID NO:676), comprising a polypeptide being at least 70%, optionally at least about 80%, preferably at least about 85%, more preferably at least about 90% and most preferably at least about 95% homologous to the sequence NSPGSADSIPPVPAG (SEQ ID NO:954) in T46984_PEA.sub.--1_P45 (SEQ ID NO:676).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA.sub.--1_P45 (SEQ ID NO:676) also has the following non-silent SNPs (Single Nucleotide Polymorphisms) as listed in Table 42, (given according to their position(s) on the amino acid sequence, with the alternative amino acid(s) listed; the last column indicates whether the SNP is known or not; the presence of known SNPs in variant protein T46984_PEA.sub.--1_P45 (SEQ ID NO:676) sequence provides support for the deduced sequence of this variant protein according to the present invention). TABLE-US-01065 TABLE 42 Amino acid mutations SNP position(s) on amino acid Alternative sequence amino acid(s) Previously known SNP? 4 P→No 25 P→R Yes 99 G→R Yes The glycosylation sites of variant protein T46984_PEA.sub.--1_P45 (SEQ ID NO:676), as compared to the known protein Dolichyl-diphosphooligosaccharide— protein glycosyltransferase 63 kDa subunit precursor (SEQ ID NO:663), are described in Table 43 (given according to their position(s) on the amino acid sequence in the first column; the second column indicates whether the glycosylation site is present in the variant protein; and the last column indicates whether the position is different on the variant protein). TABLE-US-01066 TABLE 43 Glycosylation site(s) Position(s) on known Present in amino acid sequence variant protein? 106 no Variant protein T46984_PEA.sub.--1_P45 (SEQ ID NO:676) is encoded by the following transcript(s):

T46984_PEA.sub.--1_T32 (SEQ ID NO:602), for which the sequence(s) is/are given at the end of the application. The coding portion of transcript T46984_PEA.sub.--1_T32 (SEQ ID NO:602) is shown in bold; this coding portion starts at position 316 and ends at position 663. The transcript also has the following SNPs as listed in Table 44 (given according to their position on the nucleotide sequence, with the alternative nucleic acid listed; the last column indicates whether the SNP is known or not; the presence of known SNPs in variant protein T46984_PEA.sub.--1_P45 (SEQ ID NO:676) sequence provides support for the deduced sequence of this variant protein according to the present invention). TABLE-US-01067 TABLE 44 Nucleic acid SNPs SNP position on Alternative Previously nucleotide sequence nucleic acid known SNP? 28 G→C No 173 G→C Yes 256 C→T Yes 274 G→C Yes 325 C→No 389 C→G Yes 610 G→A Yes 668 C→T Yes 681 →G No 709 C→No 721 →G No 826 G→A No 872A→No 872A→G No 892 A→C No 900 G→A Yes 1011 A→No 1011 A→C No 1044 A→G No 1044 A→T No 1078 T→G No 1115 A→C No 1117 C→G No 1127 G→A No 1200 G→T Yes 1412 A→C No 1442 T→No 1442 T→C No 1484 T→No 1517 A→C No 1517 A→T No 1748 C→No 1748 C→A No 1755 C→No 1759 G→No 1944 C→A No 1964 T→C Yes 2058 C→T No 2091 A→C No 2103 A→T No 2118 G→A Yes 2124 →A No 2133 A→G No 2158 T→G No 2172 T→A No 2172 T→G No 2272→C No 2281 T→No 2340 A→C No Variant protein T46984_PEA.sub.--1_P46 (SEQ ID NO:677) according to the present invention has an amino acid sequence as given at the end of the application; it is encoded by transcript(s) T46984_PEA.sub.--1_T35 (SEQ ID NO:604). An alignment is given to the known protein (Dolichyl-diphosphooligosaccharide—protein glycosyltransferase 63 kDa subunit precursor (SEQ ID NO:663)) at the end of the application. One or more alignments to one or more previously published protein sequences are given at the end of the application. A brief description of the relationship of the variant protein according to the present invention to each such aligned protein is as follows:

Comparison report between T46984_PEA.sub.--1_P46 (SEQ ID NO:677) and RIB2_HUMAN (SEQ. ID NO:663):

1. An isolated chimeric polypeptide encoding for T46984_PEA.sub.--1_P46 (SEQ ID NO:677), comprising a first amino acid sequence being at least 90% homologous to MAPPGSSTVFLLALTIIASTWALTPTH-YLTKHDVERLKASLDRPFTNLESAFYSIVGLSSL GAQVPDAK corresponding to amino acids 1-69 of RIB2_HUMAN (SEQ ID NO:663), which also corresponds to amino acids 1-69 of T46984_PEA.sub.--1_P46 (SEQ ID NO:677), and a second amino acid sequence being at least 70%, optionally at least 80%, preferably at least 85%, more preferably at least 90% and most preferably at least 95% homologous to a polypeptide having the sequence NSPGSADSIPPVPAG (SEQ ID NO:954) corresponding to amino acids 70-84 of T46984_PEA.sub.--1_P46 (SEQ ID NO:677), wherein said first amino acid sequence and second amino acid sequence are contiguous and in a sequential order.

2. An isolated polypeptide encoding for a tail of T46984_PEA.sub.--1_P46 (SEQ ID NO:677), comprising a polypeptide being at least 70%, optionally at least about 80%, preferably at least about 85%, more preferably at least about 90% and most preferably at least about 95% homologous to the sequence NSPGSADSIPPVPAG (SEQ ID NO:954) in T46984_PEA.sub.--1_P46 (SEQ ID NO:677).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T46984_PEA.sub.--1_P46 (SEQ ID NO:677) also has the following non-silent SNPs (Single Nucleotide Polymorphisms) as listed in Table 45, (given according to their position(s) on the amino acid sequence, with the alternative amino acid(s) listed; the last column indicates whether the SNP is known or not; the presence of known SNPs in variant protein T46984_PEA.sub.--1_P46 (SEQ ID NO:677) sequence provides support for the deduced sequence of this variant protein according to the present invention) TABLE-US-01068 TABLE 45 Amino acid mutations SNP position(s) on Alternative Previously amino acid sequence amino acid(s) known SNP? 4 P→No 25 P→R Yes The glycosylation sites of variant protein T46984_PEA.sub.--1_P46 (SEQ ID NO:677), as compared to the known protein Dolichyl-diphosphooligosaccharide—protein glycosyltransferase 63 kDa subunit precursor (SEQ ID NO:663), are described in Table 46 (given according to their position(s) on the amino acid sequence in the first column; the second column indicates whether the glycosylation site is present in the variant protein; and the last column indicates whether the position is different on the variant protein). TABLE-US-01069 TABLE 46 Glycosylation site(s) Position(s) on known Present in amino acid sequence variant protein? 106 no Variant protein T46984_PEA.sub.--1_P46 (SEQ ID NO:677) is encoded by the following transcript(s): T46984_PEA.sub.--1_T35 (SEQ ID NO:604), for which the sequence(s) is/are given at the end of the application. The coding portion of transcript T46984_PEA.sub.--1_T35 (SEQ ID NO:604) is shown in bold; this coding portion starts at position 316 and ends at position 567. The transcript also has the following SNPs as listed in Table 47 (given according to their position on the nucleotide sequence, with the alternative nucleic acid listed; the last column indicates whether the SNP is known or not; the presence of known SNPs in variant protein T46984_PEA.sub.--1_P46 (SEQ ID NO:677) sequence provides support for the deduced sequence of this variant protein according to the present invention). TABLE-US-01070 TABLE 47 Nucleic acid SNPs SNP position on Alternative Previously nucleotide sequence nucleic acid known SNP? 28 G→C No 173 G→C Yes 256 C→T Yes 274 G→C Yes 325 C→No 389 C→G Yes 572 C→T Yes 585 →G No 613 C→No 625→G No 730 G→A No 776 A→No 776 A→G No 796 A→C No 804 G→A Yes 915 A→No 915 A→C No 948 A→G No 948 A→T No 982 T→G No 1019 A→C No 1021 C→G No 1031 G→A No 1104G→T Yes 1316 A→C No 1346 T→No 1346 T→C No 1388 T→No 1421 A→C No 1421 A→T No 1652 C→No 1652 C→A No 1659 C→No 1663 G→No 1848 C→A No 1868T→C Yes 1962 C→T No 1995A→C No 2007 A→T No 2022 G→A Yes 2028 →A No 2037 A→G No 2062 T→G No 2076 T→A No 2076 T→G No 2176 →C No 2185 T→No 2244 A→C No As noted above, cluster T46984 features 49 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T46984_PEA.sub.--1_node.sub.--2 (SEQ ID NO:614) according to the present invention is supported by 240 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T40 (SEQ ID NO:605), T46984_PEA.sub.--1_T42 (SEQ ID NO:606), T46984_PEA.sub.--1_T43 (SEQ ID NO:607), T46984_PEA.sub.--1_T47 (SEQ ID NO:609) and T46984_PEA.sub.--1_T48 (SEQ ID NO:610). Table 48 below describes the starting and ending position of this segment on each transcript. TABLE-US-01071 TABLE 48 Segment location on transcripts Segment Segment starting ending Transcript name position position T46984_PEA -1_T2 (SEQ ID NO: 593) 1 328 T46984_PEA__1_T3 (SEQ ID NO: 594) 1 328 T46984_PEA__1_T12 (SEQ ID 1 328 NO: 595) T46984_PEA__1_T13 (SEQ ID 1 328 NO: 596) T46984_PEA__1_T14 (SEQ ID 1 328 NO: 597) T46984_PEA__1_T15 (SEQ ID 1 328 NO: 598) T46984_PEA__1_T19 (SEQ ID 1 328 NO: 599) T46984_PEA__1_T23 (SEQ ID 1 328 NO: 600) T46984_PEA__1_T32 (SEQ ID 1 328 NO: 602) T46984_PEA__1_T34 (SEQ ID 1 328 NO: 603) T46984_PEA__1_T35 (SEQ ID 1 328 NO: 604) T46984_PEA__1_T40 (SEQ ID 1 328 NO: 605) T46984_PEA__1_T42 (SEQ ID 1 328 NO: 606) T46984_PEA__1_T43 (SEQ ID 1 328 NO: 607) T46984_PEA__1_T47 (SEQ ID 1 328 NO: 609) T46984_PEA__1_T48 (SEQ ID 1 328 NO: 610)

Segment cluster T46984_PEA.sub.--1_node.sub.--4 (SEQ ID NO:615) according to the present invention is supported by 321 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T40 (SEQ ID NO:605), T46984_PEA.sub.--1_T42 (SEQ ID NO:606), T46984_PEA.sub.--1_T43 (SEQ ID NO:607), T46984_PEA.sub.--1_T47 (SEQ ID NO:609) and T46984_PEA.sub.--1_T48 (SEQ ID NO:610). Table 49 below describes the starting and ending position of this segment on each transcript. TABLE-US-01072 TABLE 49 Segment location on transcripts Segment Segment starting ending Transcript name position position T46984_PEA__1_T2 (SEQ ID NO: 593) 329 522 T46984_PEA__1_T3 (SEQ ID NO: 594) 329 522 T46984_PEA__1_T12 (SEQ ID 329 522 NO: 595) T46984_PEA__1_T13 (SEQ ID 329 522 NO: 596) T46984_PEA__1_T14 (SEQ ID 329 522 NO: 597) T46984_PEA__1_T15 (SEQ ID 329 522 NO: 598) T46984_PEA__1_T19 (SEQ ID 329 522 NO: 599) T46984_PEA__1_T23 (SEQ ID 329 522 NO: 600) T46984_PEA__1_T32 (SEQ ID 329 522 NO: 602) T46984_PEA__1_T34 (SEQ ID 329 522 NO: 603) T46984_PEA__1_T35 (SEQ ID 329 522 NO: 604) T46984_PEA__1_T40 (SEQ ID 329 522 NO: 605) T46984_PEA__1_T42 (SEQ ID 329 522 NO: 606) T46984_PEA__1_T43 (SEQ ID 329 522 NO: 607) T46984_PEA__1_T47 (SEQ ID 329 522 NO: 609) T46984_PEA__1_T48 (SEQ ID 329 522 NO: 610)

Segment cluster T46984_PEA.sub.--1_node.sub.--6 (SEQ ID NO:616) according to the present invention is supported by 3 libraries. The number of libraries was determined as previously described. This segment can be found in the following transcript(s): T46984_PEA.sub.--1_T27 (SEQ ID NO:601). Table 50 below describes the starting and ending position of this segment on each transcript. TABLE-US-01073 TABLE 50 Segment location on transcripts Segment Segment Transcript name starting position ending position T46984_PEA__1_T27 (SEQ ID 1 340 NO: 601)

Segment cluster T46984_PEA.sub.--1_node.sub.--12 (SEQ ID NO:617) according to the present invention is supported by 262 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T34 (SEQ ID NO:603), T46984_PEA.sub.--1_T40 (SEQ ID NO:605), T46984_PEA.sub.--1_T42 (SEQ ID NO:606), T46984_PEA.sub.--1_T43 (SEQ ID NO:607), T46984_PEA.sub.--1_T47 (SEQ ID NO:609) and T46984_PEA.sub.--1_T48 (SEQ ID NO:610). Table 51 below describes the starting and ending position of this segment on each transcript. TABLE-US-01074 TABLE 51 Segment location on transcripts Segment Segment starting ending Transcript name position position T46984_PEA__1_T2 (SEQ ID NO: 593) 619 751 T46984_PEA__1_T3 (SEQ ID NO: 594) 619 751 T46984_PEA__1_T12 (SEQ ID 619 751 NO: 595) T46984_PEA__1_T13 (SEQ ID 619 751 NO: 596) T46984_PEA__1_T14 (SEQ ID 619 751 NO: 597) T46984_PEA__1_T15 (SEQ ID 619 751 NO: 598) T46984_PEA__1_T19 (SEQ ID 619 751 NO: 599) T46984_PEA__1_T23 (SEQ ID 619 751 NO: 600) T46984_PEA__1_T27 (SEQ ID 437 569 NO: 601) T46984_PEA__1_T34 (SEQ ID 619 751 NO: 603) T46984_PEA__1_T40 (SEQ ID 619 751 NO: 605) T46984_PEA__1_T42 (SEQ ID 619 751 NO: 606) T46984_PEA__1_T43 (SEQ ID 619 751 NO: 607) T46984_PEA__1_T47 (SEQ ID 619 751 NO: 609) T46984_PEA__1_T48 (SEQ ID 619 751 NO: 610)

Segment cluster T46984_PEA.sub.--1_node.sub.--14 (SEQ ID NO:618) according to the present invention is supported by 2 libraries. The number of libraries was determined as previously described. This segment can be found in the following transcript(s): T46984_PEA.sub.--1_T48 (SEQ ID NO:610). Table 52 below describes the starting and ending position of this segment on each transcript. TABLE-US-01075 TABLE 52 Segment location on transcripts Segment Segment Transcript name starting position ending position T46984_PEA__1_T48 (SEQ ID 795 1718 NO: 610)

Segment cluster T46984_PEA.sub.--1_node.sub.--25 (SEQ ID NO:619) according to the present invention is supported by 257 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T40 (SEQ ID NO:605), T46984_PEA.sub.--1_T42 (SEQ ID NO:606) and T46984_PEA.sub.--1_T43 (SEQ ID NO:607). Table 53 below describes the starting and ending position of this segment on each transcript. TABLE-US-01076 TABLE 53 Segment location on transcripts Segment Segment starting ending Transcript name position position T46984_PEA__1_T2 (SEQ ID NO: 593) 1006 1171 T46984_PEA__1_T3 (SEQ ID NO: 594) 1006 1171 T46984_PEA__1_T12 (SEQ ID 1006 1171 NO: 595) T46984_PEA__1_T13 (SEQ ID 1006 1171 NO: 596) T46984_PEA__1_T14 (SEQ ID 1006 1171 NO: 597) T46984_PEA__1_T15 (SEQ ID 1006 1171 NO: 598) T46984_PEA__1_T19 (SEQ ID 1006 1171 NO: 599) T46984_PEA__1_T23 (SEQ ID 1006 1171 NO: 600) T46984_PEA__1_T27 (SEQ ID 824 989 NO: 601) T46984_PEA__1_T32 (SEQ ID 830 995 NO: 602) T46984_PEA__1_T34 (SEQ ID 1006 1171 NO: 603) T46984_PEA__1_T35 (SEQ ID 734 899 NO: 604) T46984_PEA__1_T40 (SEQ ID 1006 1171 NO: 605) T46984_PEA__1_T42 (SEQ ID 1006 1171 NO: 606) T46984_PEA__1_T43 (SEQ ID 1006 1171 NO: 607)

Segment cluster T46984_PEA.sub.--1_node.sub.--29 (SEQ ID NO:620) according to the present invention is supported by 1 libraries. The number of libraries was determined as previously described. This segment can be found in the following transcript(s): T46984_PEA.sub.--1_T42 (SEQ ID NO:606). Table 54 below describes the starting and ending position of this segment on each transcript. TABLE-US-01077 TABLE 54 Segment location on transcripts Segment Segment Transcript name starting position ending position T46984_PEA__1_T42 (SEQ ID 1302 1501 NO: 606)

Segment cluster T46984_PEA.sub.--1_node.sub.--34 (SEQ ID NO:621) according to the present invention is supported by 4 libraries. The number of libraries was determined as previously described. This segment can be found in the following transcript(s): T46984_PEA.sub.--1_T40 (SEQ ID NO:605). Table 55 below describes the starting and ending position of this segment on each transcript. TABLE-US-01078 TABLE 55 Segment location on transcripts Segment Segment Transcript name starting position ending position T46984_PEA__1_T40 (SEQ ID 1408 1717 NO: 605)

Segment cluster T46984_PEA.sub.--1_node.sub.--46 (SEQ ID NO:622) according to the present invention is supported by 1 libraries. The number of libraries was determined as previously described. This segment can be found in the following transcript(s): T46984_PEA.sub.--1_T46 (SEQ ID NO:608). Table 56 below describes the starting and ending position of this segment on each transcript. TABLE-US-01079 TABLE 56 Segment location on transcripts Segment Segment Transcript name starting position ending position T46984_PEA__1_T46 (SEQ ID 1 306 NO: 608)

Segment cluster T46984_PEA.sub.--1_node.sub.--47 (SEQ ID NO:623) according to the present invention is supported by 5 libraries. The number of libraries was determined as previously described. This segment can be found in the following transcript(s): T46984_PEA.sub.--1_T3 (SEQ ID NO:594), T46984_PEA.sub.--1_T19 (SEQ ID NO:599) and T46984_PEA.sub.--1_T46 (SEQ ID NO:608). Table 57 below describes the starting and ending position of this segment on each transcript. TABLE-US-01080 TABLE 57 Segment location on transcripts Segment Segment starting ending Transcript name position position T46984_PEA__1_T3 (SEQ ID NO: 594) 1615 2242 T46984_PEA__1_T19 (SEQ ID 1615 2242 NO: 599) T46984_PEA__1_T46 (SEQ ID 307 934 NO: 608)

Segment cluster T46984_PEA.sub.--1_node.sub.--52 (SEQ ID NO:624) according to the present invention is supported by 29 libraries. The number of libraries was determined as previously described. This segment can be found in the following transcript(s): T46984_PEA.sub.--1_T2 (SEQ ID NO:593), T46984_PEA.sub.--1_T19 (SEQ ID NO:599) and T46984_PEA.sub.--1_T23 (SEQ ID NO:600). Table 58 below describes the starting and ending position of this segment on each transcript. TABLE-US-01081 TABLE 58 Segment location on transcripts Segment Segment starting ending Transcript name position position T46984_PEA__1_T2 (SEQ ID NO: 593) 1838 2904 T46984_PEA__1_T19 (SEQ ID 2466 3532 NO: 599) T46984_PEA__1_T23 (SEQ ID 1838 2904 NO: 600)

Segment cluster T46984_PEA.sub.--1_node.sub.--65 (SEQ ID NO:625) according to the present invention is supported by 2 libraries. The number of libraries was determined as previously described. This segment can be found in the following transcript(s): T46984_PEA.sub.--1_T51 (SEQ ID NO:611). Table 59 below describes the starting and ending position of this segment on each transcript. TABLE-US-01082 TABLE 59 Segment location on transcripts Segment Segment Transcript name starting position ending position T46984_PEA__1_T51 (SEQ ID 1 348 NO: 611)

Segment cluster T46984_PEA.sub.--1_node.sub.--69 (SEQ ID NO:626) according to the present invention is supported by 8 libraries. The number of libraries was determined as previously described. This segment can be found in the following transcript(s): T46984_PEA.sub.--1_T52 (SEQ ID NO:612) and T46984_PEA.sub.--1_T54 (SEQ ID NO:613). Table 60 below describes the starting and ending position of this segment on each transcript. TABLE-US-01083 TABLE 60 Segment location on transcripts Segment Segment Transcript name starting position ending position T46984_PEA__1_T52 (SEQ ID 1 927 NO: 612) T46984_PEA__1_T54 (SEQ ID 1 927 NO: 613)

Segment cluster T46984_PEA.sub.--1_node.sub.--75 (SEQ ID NO:627) according to the present invention is supported by 5 libraries. The number of libraries was determined as previously described. This segment can be found in the following transcript(s): T46984_PEA.sub.--1_T14 (SEQ ID NO:597). Table 61 below describes the starting and ending position of this segment on each transcript. TABLE-US-01084 TABLE 61 Segment location on transcripts Segment Segment Transcript name starting position ending position T46984_PEA__1_T14 (SEQ ID 2199 3529 NO: 597)

Segment cluster T46984_PEA.sub.--1_node.sub.--86 (SEQ ID NO:628) according to the present invention is supported by 314 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T43 (SEQ ID NO:607), T46984_PEA.sub.--1_T46 (SEQ ID NO:608), T46984_PEA.sub.--1_T47 (SEQ ID NO:609), T46984_PEA.sub.--1_T51 (SEQ ID NO:611), T46984_PEA.sub.--1_T52 (SEQ ID NO:612) and T46984_PEA.sub.--1_T54 (SEQ ID NO:613). Table 62 below describes the starting and ending position of this segment on each transcript. TABLE-US-01085 TABLE 62 Segment location on transcripts Segment Segment starting ending Transcript name position position T46984_PEA__1_T2 (SEQ ID NO: 593) 3492 3750 T46984_PEA__1_T3 (SEQ ID NO: 594) 2886 3144 T46984_PEA__1_T12 (SEQ ID 2286 2544 NO: 595) T46984_PEA__1_T13 (SEQ ID 2317 2575 NO: 596) T46984_PEA__1_T15 (SEQ ID 2175 2433 NO: 598) T46984_PEA__1_T19 (SEQ ID 4120 4378 NO: 599) T46984_PEA__1_T23 (SEQ ID 3396 3654 NO: 600) T46984_PEA__1_T27 (SEQ ID 2076 2334 NO: 601) T46984_PEA__1_T32 (SEQ ID 2082 2340 NO: 602) T46984_PEA__1_T34 (SEQ ID 1828 2086 NO: 603) T46984_PEA__1_T35 (SEQ ID 1986 2244 NO: 604) T46984_PEA__1_T43 (SEQ ID 1264 1522 NO: 607) T46984_PEA__1_T46 (SEQ ID 1578 1836 NO: 608) T46984_PEA__1_T47 (SEQ ID 1017 1275 NO: 609) T46984_PEA__1_T51 (SEQ ID 614 872 NO: 611) T46984_PEA__1_T52 (SEQ ID 1117 1375 NO: 612) T46984_PEA__1_T54 (SEQ ID 1117 1602 NO: 613)

According to an optional embodiment of the present invention, short segments related to the above cluster are also provided. These segments are up to about 120 bp in length, and so are included in a separate description.

Segment cluster T46984_PEA.sub.--1_node.sub.--9 (SEQ ID NO:629) according to the present invention is supported by 304 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T40 (SEQ ID NO:605), T46984_PEA.sub.--1_T42 (SEQ ID NO:606), T46984_PEA.sub.--1_T43 (SEQ ID NO:607), T46984_PEA.sub.--1_T47 (SEQ ID NO:609) and T46984_PEA.sub.--1_T48 (SEQ ID NO:610). Table 63 below describes the starting and ending position of this segment on each transcript. TABLE-US-01086 TABLE 63 Segment location on transcripts Segment Segment starting ending Transcript name position position T46984_PEA__1_T2 (SEQ ID NO: 593) 523 618 T46984_PEA__1_T3 (SEQ ID NO: 594) 523 618 T46984_PEA__1_T12 (SEQ ID 523 618 NO: 595) T46984_PEA__1_T13 (SEQ ID 523 618 NO: 596) T46984_PEA__1_T14 (SEQ ID 523 618 NO: 597) T46984_PEA__1_T15 (SEQ ID 523 618 NO: 598) T46984_PEA__1_T19 (SEQ ID 523 618 NO: 599) T46984_PEA__1_T23 (SEQ ID 523 618 NO: 600) T46984_PEA__1_T27 (SEQ ID 341 436 NO: 601) T46984_PEA__1_T32 (SEQ ID 523 618 NO: 602) T46984_PEA__1_T34 (SEQ ID 523 618 NO: 603) T46984_PEA__1_T40 (SEQ ID 523 618 NO: 605) T46984_PEA__1_T42 (SEQ ID 523 618 NO: 606) T46984_PEA__1_T43 (SEQ ID 523 618 NO: 607) T46984_PEA__1_T47 (SEQ ID 523 618 NO: 609) T46984_PEA__1_T48 (SEQ ID 523 618 NO: 610)

Segment cluster T46984_PEA.sub.--1_node.sub.--13 (SEQ ID NO:630) according to the present invention is supported by 232 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T34 (SEQ ID NO:603), T46984_PEA.sub.--1_T40 (SEQ ID NO:605), T46984_PEA.sub.--1_T42 (SEQ ID NO:606), T46984_PEA.sub.--1_T43 (SEQ ID NO:607) and T46984_PEA.sub.--1_T48 (SEQ ID NO:610). Table 64 below describes the starting and ending position of this segment on each transcript. TABLE-US-01087 TABLE 64 Segment location on transcripts Segment Segment starting ending Transcript name position position T46984_PEA__1_T2 (SEQ ID NO: 593) 752 794 T46984_PEA__1_T3 (SEQ ID NO: 594) 752 794 T46984_PEA__1_T12 (SEQ ID 752 794 NO: 595) T46984_PEA__1_T13 (SEQ ID 752 794 NO: 596) T46984_PEA__1_T14 (SEQ ID 752 794 NO: 597) T46984_PEA__1_T15 (SEQ ID 752 794 NO: 598) T46984_PEA__1_T19 (SEQ ID 752 794 NO: 599) T46984_PEA__1_T23 (SEQ ID 752 794 NO: 600) T46984_PEA__1_T27 (SEQ ID 570 612 NO: 601) T46984_PEA__1_T34 (SEQ ID 752 794 NO: 603) T46984_PEA__1_T40 (SEQ ID 752 794 NO: 605) T46984_PEA__1_T42 (SEQ ID 752 794 NO: 606) T46984_PEA__1_T43 (SEQ ID 752 794 NO: 607) T46984_PEA__1_T48 (SEQ ID 752 794 NO: 610)

Segment cluster T46984_PEA.sub.--1_node.sub.--1 9 (SEQ ID NO:631) according to the present invention is supported by 237 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T40 (SEQ ID NO:605), T46984_PEA.sub.--1_T42 (SEQ ID NO:606) and T46984_PEA.sub.--1_T43 (SEQ ID NO:607). Table 65 below describes the starting and ending position of this segment on each transcript.

TABLE 65
Segment location on transcripts

| Transcript name | Segment starting position | Segment ending position |
|---|---|---|
| T46984_PEA_1_T2 (SEQ ID NO: 593) | 795 | 870 |
| T46984_PEA_1_T3 (SEQ ID NO: 594) | 795 | 870 |
| T46984_PEA_1_T12 (SEQ ID NO: 595) | 795 | 870 |
| T46984_PEA_1_T13 (SEQ ID NO: 596) | 795 | 870 |
| T46984_PEA_1_T14 (SEQ ID NO: 597) | 795 | 870 |
| T46984_PEA_1_T15 (SEQ ID NO: 598) | 795 | 870 |
| T46984_PEA_1_T19 (SEQ ID NO: 599) | 795 | 870 |
| T46984_PEA_1_T23 (SEQ ID NO: 600) | 795 | 870 |
| T46984_PEA_1_T27 (SEQ ID NO: 601) | 613 | 688 |
| T46984_PEA_1_T32 (SEQ ID NO: 602) | 619 | 694 |
| T46984_PEA_1_T34 (SEQ ID NO: 603) | 795 | 870 |
| T46984_PEA_1_T35 (SEQ ID NO: 604) | 523 | 598 |
| T46984_PEA_1_T40 (SEQ ID NO: 605) | 795 | 870 |
| T46984_PEA_1_T42 (SEQ ID NO: 606) | 795 | 870 |
| T46984_PEA_1_T43 (SEQ ID NO: 607) | 795 | 870 |

Segment cluster T46984_PEA.sub.--1_node.sub.--21 (SEQ ID NO:632) according to the present invention is supported by 242 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T40 (SEQ ID NO:605), T46984_PEA.sub.--1_T42 (SEQ ID NO:606) and T46984_PEA.sub.--1_T43 (SEQ ID NO:607). Table 66 below describes the starting and ending position of this segment on each transcript.

TABLE 66
Segment location on transcripts

| Transcript name | Segment starting position | Segment ending position |
|---|---|---|
| T46984_PEA_1_T2 (SEQ ID NO: 593) | 871 | 975 |
| T46984_PEA_1_T3 (SEQ ID NO: 594) | 871 | 975 |
| T46984_PEA_1_T12 (SEQ ID NO: 595) | 871 | 975 |
| T46984_PEA_1_T13 (SEQ ID NO: 596) | 871 | 975 |
| T46984_PEA_1_T14 (SEQ ID NO: 597) | 871 | 975 |
| T46984_PEA1_T15 (SEQ ID NO: 598) | 871 | 975 |
| T46984_PEA_1_T19 (SEQ ID NO: 599) | 871 | 975 |
| T46984_PEA_1_T23 (SEQ ID NO: 600) | 871 | 975 |
| T46984_PEA_1_T27 (SEQ ID NO: 601) | 689 | 793 |
| T46984_PEA_1_T32 (SEQ ID NO: 602) | 695 | 799 |
| T46984_PEA_1_T34 (SEQ ID NO: 603) | 871 | 975 |
| T46984_PEA_1_T35 (SEQ ID NO: 604) | 599 | 703 |
| T46984_PEA_1_T40 (SEQ ID NO: 605) | 871 | 975 |
| T46984_PEA_1_T42 (SEQ ID NO: 606) | 871 | 975 |
| T46984_PEA_1_T43 (SEQ ID NO: 607) | 871 | 975 |

Segment cluster T46984_PEA.sub.--1_node.sub.--22 (SEQ ID NO:633) according to the present invention is supported by 205 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T40 (SEQ ID NO:605), T46984_PEA.sub.--1_T42 (SEQ ID NO:606) and T46984_PEA.sub.--1_T43 (SEQ ID NO:607). Table 67 below describes the starting and ending position of this segment on each transcript.

TABLE 67
Segment location on transcripts

| Transcript name | Segment starting position | Segment ending position |
|---|---|---|
| T46984_PEA_1_T2 (SEQ ID NO: 593) | 976 | 1005 |
| T46984_PEA_1_T3 (SEQ ID NO: 594) | 976 | 1005 |
| T46984_PEA_1_T12 (SEQ ID NO: 595) | 976 | 1005 |
| T46984_PEA_1_T13 (SEQ ID NO: 596) | 976 | 1005 |
| T46984_PEA_1_T14 (SEQ ID NO: 597) | 976 | 1005 |
| T46984_PEA_1_T15 (SEQ ID NO: 598) | 976 | 1005 |
| T46984_PEA_1_T19 (SEQ ID NO: 599) | 976 | 1005 |
| T46984_PEA_1_T23 (SEQ ID NO: 600) | 976 | 1005 |
| T46984_PEA_1_T27 (SEQ ID NO: 601) | 794 | 823 |
| T46984_PEA_1_T32 (SEQ ID NO: 602) | 800 | 829 |
| T46984_PEA_1_T34 (SEQ ID NO: 603) | 976 | 1005 |
| T46984_PEA_1_T35 (SEQ ID NO: 604) | 704 | 733 |
| T46984_PEA_1_T40 (SEQ ID NO: 605) | 976 | 1005 |
| T46984_PEA_1_T42 (SEQ ID NO: 606) | 976 | 1005 |
| T46984_PEA_1_T43 (SEQ ID NO: 607) | 976 | 1005 |

Segment cluster T46984_PEA.sub.--1_node.sub.--26 (SEQ ID NO:634) according to the present invention can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T40 (SEQ ID NO:605) and T46984_PEA.sub.--1_T42 (SEQ ID NO:606). Table 68 below describes the starting and ending position of this segment on each transcript.

TABLE 68
Segment location on transcripts

| Transcript name | Segment starting position | Segment ending position |
|---|---|---|
| T46984_PEA_1_T2 (SEQ ID NO: 593) | 1172 | 1182 |
| T46984_PEA_1_T3 (SEQ ID NO: 594) | 1172 | 1182 |
| T46984_PEA_1_T12 (SEQ ID NO: 595) | 1172 | 1182 |
| T46984_PEA_1_T13 (SEQ ID NO: 596) | 1172 | 1182 |
| T46984_PEA_1_T14 (SEQ ID NO: 597) | 1172 | 1182 |
| T46984_PEA_1_T15 (SEQ ID NO: 598) | 1172 | 1182 |
| T46984_PEA_1_T19 (SEQ ID NO: 599) | 1172 | 1182 |
| T46984_PEA_1_T23 (SEQ ID NO: 600) | 1172 | 1182 |
| T46984_PEA_1_T27 (SEQ ID NO: 601) | 990 | 1000 |
| T46984_PEA_1_T32 (SEQ ID NO: 602) | 996 | 1006 |
| T46984_PEA_1_T34 (SEQ ID NO: 603) | 1172 | 1182 |
| T46984_PEA_1_T35 (SEQ ID NO: 604) | 900 | 910 |
| T46984_PEA_1_T40 (SEQ ID NO: 605) | 1172 | 1182 |
| T46984_PEA_1_T42 (SEQ ID NO: 606) | 1172 | 1182 |

Segment cluster T46984_PEA.sub.--1_node.sub.--28 (SEQ ID NO:635) according to the present invention is supported by 242 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599),
T46984_PEA.sub.--1_T23 (SEQ ID NO:600),
T46984_PEA.sub.--1_T27 (SEQ ID NO:601),
T46984_PEA.sub.--1_T32 (SEQ ID NO:602),
T46984_PEA.sub.--1_T34 (SEQ ID NO:603),
T46984_PEA.sub.--1_T35 (SEQ ID NO:604),
T46984_PEA.sub.--1_T40 (SEQ ID NO:605) and
T46984_PEA.sub.--1_T42 (SEQ ID NO:606). Table 69 below describes the starting and ending position of this segment on each transcript. TABLE-US-01092 TABLE 69 Segment location on transcripts Segment Segment ending Transcript name starting position position T46984_PEA__1_T2 (SEQ ID NO: 593) 1183 1301 T46984_PEA__1_T3 (SEQ ID NO: 594) 1183 1301 T46984_PEA__1_T12 (SEQ ID 1183 1301 NO: 595) T46984_PEA__1_T13 (SEQ ID 1183 1301 NO: 596) T46984_PEA__1_T14 (SEQ ID 1183 1301 NO: 597) T46984_PEA__1_T15 (SEQ ID 1183 1301 NO: 598) T46984_PEA__1_T19 (SEQ ID 1183 1301 NO: 599) T46984_PEA__1_T23 (SEQ ID 1183 1301 NO: 600) T46984_PEA__1_T27 (SEQ ID 1001 1119 NO: 601) T46984_PEA__1_T32 (SEQ ID 1007 1125 NO: 602) T46984_PEA__1_T34 (SEQ ID 1183 1301 NO: 603) T46984_PEA__1_T35 (SEQ ID 911 1029 NO: 604) T46984_PEA__1_T40 (SEQ ID 1183 1301 NO: 605) T46984_PEA__1_T42 (SEQ ID 1183 1301 NO: 606)

Segment cluster T46984_PEA.sub.--1_node.sub.--31 (SEQ ID NO:636) according to the present invention is supported by 207 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604) and T46984_PEA.sub.--1_T40 (SEQ ID NO:605). Table 70 below describes the starting and ending position of this segment on each transcript. TABLE-US-01093 TABLE 70 Segment location on transcripts Segment Segment ending Transcript name starting position position T46984_PEA__1_T2 (SEQ ID NO: 593) 1302 1329 T46984_PEA__1_T3 (SEQ ID NO: 594) 1302 1329 T46984_PEA__1_T12 (SEQ ID 1302 1329 NO: 595) T46984_PEA__1_T13 (SEQ ID 1302 1329 NO: 596) T46984_PEA__1_T14 (SEQ ID 1302 1329 NO: 597) T46984_PEA__1_T15 (SEQ ID 1302 1329 NO: 598) T46984_PEA__1_T19 (SEQ ID 1302 1329 NO: 599) T46984_PEA__1_T23 (SEQ ID 1302 1329 NO: 600) T46984_PEA__1_T27 (SEQ ID 1120 1147 NO: 601) T46984_PEA__1_T32 (SEQ ID 1126 1153 NO: 602) T46984_PEA__1_T34 (SEQ ID 1302 1329 NO: 603) T46984_PEA__1_T35 (SEQ ID 1030 1057 NO: 604) T46984_PEA__1_T40 (SEQ ID 1302 1329 NO: 605)

Segment cluster T46984_PEA.sub.--1_node.sub.--32 (SEQ ID NO:637) according to the present invention is supported by 226 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604) and T46984_PEA.sub.--1_T40 (SEQ ID NO:605). Table 71 below describes the starting and ending position of this segment on each transcript. TABLE-US-01094 TABLE 71 Segment location on transcripts Segment Segment ending Transcript name starting position position T46984_PEA__1_T2 (SEQ ID NO: 593) 1330 1407 T46984_PEA__1_T3 (SEQ ID NO: 594) 1330 1407 T46984_PEA__1_T12 (SEQ ID 1330 1407 NO: 595) T46984_PEA__1_T13 (SEQ ID 1330 1407 NO: 596) T46984_PEA__1_T14 (SEQ ID 1330 1407 NO: 597) T46984_PEA__1_T19 (SEQ ID 1330 1407 NO: 599) T46984_PEA__1_T23 (SEQ ID 1330 1407 NO: 600) T46984_PEA__1_T27 (SEQ ID 1148 1225 NO: 601) T46984_PEA__1_T32 (SEQ ID 1154 1231 NO: 602) T46984_PEA__1_T34 (SEQ ID 1330 1407 NO: 603) T46984_PEA__1_T35 (SEQ ID 1058 1135 NO: 604) T46984_PEA__1_T40 (SEQ ID 1330 1407 NO: 605)

Segment cluster T46984_PEA.sub.--1_node.sub.--38 (SEQ ID NO:638) according to the present invention can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603) and T46984_PEA.sub.--1_T35 (SEQ ID NO:604). Table 72 below describes the starting and ending position of this segment on each transcript. TABLE-US-01095 TABLE 72 Segment location on transcripts Segment Segment starting ending Transcript name position position T46984_PEA__1_T2 (SEQ ID NO: 593) 1408 1412 T46984_PEA__1_T3 (SEQ ID NO: 594) 1408 1412 T46984_PEA__1_T12 (SEQ ID 1408 1412 NO: 595) T46984_PEA__2_T13 (SEQ ID 1408 1412 NO: 596) T46984_PEA__1_T14 (SEQ ID 1408 1412 NO: 597) T46984_PEA__1_T19 (SEQ ID 1408 1412 NO: 599) T46984_PEA__1_T23 (SEQ ID 1408 1412 NO: 600) T46984_PEA__1_T27 (SEQ ID 1226 1230 NO: 601) T46984_PEA__1_T32 (SEQ ID 1232 1236 NO: 602) T46984_PEA__1_T34 (SEQ ID 1408 1412 NO: 603) T46984_PEA__1_T35 (SEQ ID 1136 1140 NO: 604)

Segment cluster T46984_PEA.sub.--1_node.sub.--39 (SEQ ID NO:639) according to the present invention can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603) and T46984_PEA.sub.--1_T35 (SEQ ID NO:604). Table 73 below describes the starting and ending position of this segment on each transcript. TABLE-US-01096 TABLE 73 Segment location on transcripts Segment Segment ending Transcript name starting position position T46984_PEA__1_T2 (SEQ ID NO: 593) 1413 1435 T46984_PEA__1_T3 (SEQ ID NO: 594) 1413 1435 T46984_PEA_1_T12 (SEQ ID 1413 1435 NO: 595) T46984_PEA_1_T13 (SEQ ID 1413 1435 NO: 596) T46984_PEA_1_T14 (SEQ ID 1413 1435 NO: 597) T46984_PEA_1_T15 (SEQ ID 1330 1352 NO: 598) T46984_PEA_1_T19 (SEQ ID 1413 1435 NO: 599) T46984_PEA_1_T23 (SEQ ID 1413 1435 NO: 600) T46984_PEA_1_T27 (SEQ ID 1231 1253 NO: 601) T46984_PEA_1_T32 (SEQ ID 1237 1259 NO: 602) T46984_PEA_1_T34 (SEQ ID 1413 1435 NO: 603) T46984_PEA_1_T35 (SEQ ID 1141 1163 NO: 604)

Segment cluster T46984_PEA.sub.--1_node.sub.--40 (SEQ ID NO:640) according to the present invention is supported by 227 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603) and T46984_PEA.sub.--1_T35 (SEQ ID NO:604). Table 74 below describes the starting and ending position of this segment on each transcript. TABLE-US-01097 TABLE 74 Segment location on transcripts Segment Segment ending Transcript name starting position position T46984_PEA_1_T2 (SEQ ID NO: 593) 1436 1499 T46984_PEA_1_T3 (SEQ ID NO: 594) 1436 1499 T46984_PEA_1_T12 (SEQ ID 1436 1499 NO: 595) T46984_PEA_1_T13 (SEQ ID 1436 1499 NO: 596) T46984_PEA_1_T14 (SEQ ID 1436 1499 NO: 597) T46984_PEA_1_T15 (SEQ ID 1353 1416 NO: 598) T46984_PEA_1_T19 (SEQ ID 1436 1499 NO: 599) T46984_PEA_1_T23 (SEQ ID 1436 1499 NO: 600) T46984_PEA_1_T27 (SEQ ID 1254 1317 NO: 601) T46984_PEA_1_T32 (SEQ ID 1260 1323 NO: 602) T46984_PEA_1_T34 (SEQ ID 1436 1499 NO: 603) T46984_PEA_1_T35 (SEQ ID 1164 1227 NO: 604)

Segment cluster T46984_PEA.sub.--1_node.sub.--42 (SEQ ID NO:641) according to the present invention is supported by 239 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603) and T46984_PEA.sub.--1_T35 (SEQ ID NO:604). Table 75 below describes the starting and ending position of this segment on each transcript. TABLE-US-01098 TABLE 75 Segment location on transcripts Segment Segment ending Transcript name starting position position T46984_PEA_1_T2 (SEQ ID NO: 593) 1500 1562 T46984 PEA_1_T3 (SEQ ID NO: 594) 1500 1562 T46984_PEA_1_T12 (SEQ ID 1500 1562 NO: 595) T46984_PEA_1_T13 (SEQ ID 1500 1562 NO: 596) T46984_PEA_1_T14 (SEQ ID 1500 1562 NO: 597) T46984_PEA_1_T15 (SEQ ID 1417 1479 NO: 598) T46984_PEA_1T19 (SEQ ID 1500 1562 NO: 599) T46984_PEA_1_T23 (SEQ ID 1500 1562 NO: 600) T46984_PEA_1_T27 (SEQ ID 1318 1380 NO: 601) T46984_PEA1_T32 (SEQ ID 1324 1386 NO: 602) T46984_PEA_1_T34 (SEQ ID 1500 1562 NO: 603) T46984_PEA_1_T35 (SEQ ID 1228 1290 NO: 604)

Segment cluster T46984_PEA.sub.--1_node.sub.--43 (SEQ ID NO:642) according to the present invention is supported by 235 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602) and T46984_PEA.sub.--1_T35 (SEQ ID NO:604). Table 76 below describes the starting and ending position of this segment on each transcript. TABLE-US-01099 TABLE 76 Segment location on transcripts Segment Segment ending Transcript name starting position position T46984_PEA_1_T2 (SEQ ID NO: 593) 1563 1614 T46984_PEA_1_T3 (SEQ ID NO: 594) 1563 1614 T46984_PEA_1_T12 (SEQ ID 1563 1614 NO: 595) T46984_PEA_1_T13 (SEQ ID 1563 1614 NO: 596) T46984_PEA_1_T14 (SEQ ID 1563 1614 NO: 597) T46984_PEA_1_T15 (SEQ ID 1480 1531 NO: 598) T46984_PEA_1_T19 (SEQ ID 1563 1614 NO: 599) T46984_PEA_1_T23 (SEQ ID 1563 1614 NO: 600) T46984_PEA_1_T27 (SEQ ID 1381 1432 NO: 601) T46984_PEA_1_T32 (SEQ ID 1387 1438 NO: 602) T46984_PEA_1_T35 (SEQ ID 1291 1342 NO: 604)

Segment cluster T46984_PEA.sub.--1_node.sub.--48 (SEQ ID NO:643) according to the present invention is supported by 282 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T35 (SEQ ID NO:604) and T46984_PEA.sub.--1_T46 (SEQ ID NO:608). Table 77 below describes the starting and ending position of this segment on each transcript. TABLE-US-01100 TABLE 77 Segment location on transcripts Segment Segment ending Transcript name starting position position T46984_PEA_1_T2 (SEQ ID NO: 593) 1615 1715 T46984_PEA_1_T3 (SEQ ID NO: 594) 2243 2343 T46984_PEA_1_T12 (SEQ ID 1615 1715 NO: 595) T46984_PEA_1_T13 (SEQ ID 1615 1715 NO: 596) T46984_PEA_1_T14 (SEQ ID 1615 1715 NO: 597) T46984_PEA_1_T15 (SEQ ID 1532 1632 NO: 598) T46984_PEA_1_T19 (SEQ ID 2243 2343 NO: 599) T46984_PEA_1_T23 (SEQ ID 1615 1715 NO: 600) T46984_PEA_1_T27 (SEQ ID 1433 1533 NO: 601) T46984_PEA_1_T32 (SEQ ID 1439 1539 NO: 602) T46984_PEA_1_T35 (SEQ ID 1343 1443 NO: 604) T46984_PEA_1_T46 (SEQ ID 935 1035 NO: 608)

Segment cluster T46984_PEA.sub.--1_node.sub.--49 (SEQ ID NO:644) according to the present invention is supported by 262 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T35 (SEQ ID NO:604) and T46984_PEA.sub.--1_T46 (SEQ ID NO:608). Table 78 below describes the starting and ending position of this segment on each transcript. TABLE-US-01101 TABLE 78 Segment location on transcripts Segment Segment ending Transcript name starting position position T46984_PEA_1_T2 (SEQ ID NO: 593) 1716 1757 T46984_PEA_1_T3 (SEQ ID NO: 594) 2344 2385 T46984_PEA_1_T12 (SEQ ID 1716 1757 NO: 595) T46984_PEA_1_T13 (SEQ ID 1716 1757 NO: 596) T46984_PEA_1_T14 (SEQ ID 1716 1757 NO: 597) T46984_PEA_1_T15 (SEQ ID 1633 1674 NO: 598) T46984_PEA_1_T19 (SEQ ID 2344 2385 NO: 599) T46984_PEA_1_T23 (SEQ ID 1716 1757 NO: 600) T46984_PEA_1_T27 (SEQ ID 1534 1575 NO: 601) T46984_PEA_1_T32 (SEQ ID 1540 1581 NO: 602) T46984_PEA_1_T35 (SEQ ID 1444 1485 NO: 604) T46984_PEA_1_T46 (SEQ ID 1036 1077 NO: 608)

Segment cluster T46984_PEA.sub.--1_node.sub.--50 (SEQ ID NO:645) according to the present invention is supported by 277 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T35 (SEQ ID NO:604) and T46984_PEA.sub.--1_T46 (SEQ ID NO:608). Table 79 below describes the starting and ending position of this segment on each transcript. TABLE-US-01102 TABLE 79 Segment location on transcripts Segment Segment ending Transcript name starting position position T46984_PEA_1_T2 (SEQ ID NO: 593) 1758 1809 T46984_PEA_1_T3 (SEQ ID NO: 594) 2386 2437 T46984_PEA_1_T12 (SEQ ID 1758 1809 NO: 595) T46984_PEA_1_T13 (SEQ ID 1758 1809 NO: 596) T46984_PEA_1_T14 (SEQ ID 1758 1809 NO: 597) T46984_PEA_1_T15 (SEQ ID 1675 1726 NO: 598) T46984_PEA_1_T19 (SEQ ID 2386 2437 NO: 599) T46984_PEA_1_T23 (SEQ ID 1758 1809 NO: 600) T46984_PEA_1_T27 (SEQ ID 1576 1627 NO: 601) T46984_PEA1_T32 (SEQ ID 1582 1633 NO: 602) T46984_PEA_1_T35 (SEQ ID 1486 1537 NO: 604) T46984_PEA_1_T46 (SEQ ID 1078 1129 NO: 608)

Segment cluster T46984_PEA.sub.--1_node.sub.--51 (SEQ ID NO:646) according to the present invention is supported by 6 libraries. The number of libraries was determined as previously described. This segment can be found in the following transcript(s): T46984_PEA.sub.--1_T2 (SEQ ID NO:593), T46984_PEA.sub.--1_T12 (SEQ ID NO:595), T46984_PEA.sub.--1_T19 (SEQ ID NO:599) and T46984_PEA.sub.--1_T23 (SEQ ID NO:600). Table 80 below describes the starting and ending position of this segment on each transcript. TABLE-US-01103 TABLE 80 Segment location on transcripts Segment Segment ending Transcript name starting position position T46984_PEA_1_T2 (SEQ ID NO: 593) 1810 1837 T46984_PEA_1_T12 (SEQ ID 1810 1837 NO: 595) T46984_PEA_1_T19 (SEQ ID 2438 2465 NO: 599) T46984_PEA_1_T23 (SEQ ID 1810 1837 NO: 600)

Segment cluster T46984_PEA.sub.--1_node.sub.--53 (SEQ ID NO:647) according to the present invention is supported by 16 libraries. The number of libraries was determined as previously described. This segment can be found in the following transcript(s): T46984_PEA.sub.--1_T2 (SEQ ID NO:593), T46984_PEA.sub.--1_T13 (SEQ ID NO:596), T46984_PEA.sub.--1_T19 (SEQ ID NO:599) and T46984_PEA.sub.--1_T23 (SEQ ID NO:600). Table 81 below describes the starting and ending position of this segment on each transcript. TABLE-US-01104 TABLE 81 Segment location on transcripts Segment Segment ending Transcript name starting position position T46984_PEA_1_T2 (SEQ ID NO: 593) 2905 2963 T46984_PEA_1_T13 (SEQ ID 1810 1868 NO: 596) T46984_PEA_1_T19 (SEQ ID 3533 3591 NO: 599) T46984_PEA_1_T23 (SEQ ID 2905 2963 NO: 600)

Segment cluster T46984_PEA.sub.--1_node.sub.--54 (SEQ ID NO:648) according to the present invention is supported by 18 libraries. The number of libraries was determined as previously described. This segment can be found in the following transcript(s): T46984_PEA.sub.--1_T2 (SEQ ID NO:593), T46984_PEA.sub.--1_T19 (SEQ ID NO:599) and T46984_PEA.sub.--1_T23 (SEQ ID NO:600). Table 82 below describes the starting and ending position of this segment on each transcript. TABLE-US-01105 TABLE 82 Segment location on transcripts Segment Segment ending Transcript name starting position position T46984_PEA_1_T2 (SEQ ID NO: 593) 2964 3043 T46984_PEA_1_T19 (SEQ ID 3592 3671 NO: 599) T46984_PEA_1_T23 (SEQ ID 2964 3043 NO: 600)

Segment cluster T46984_PEA.sub.--1_node.sub.--55 (SEQ ID NO:649) according to the present invention is supported by 335 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1.sub.--T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T35 (SEQ ID NO:604) and T46984_PEA.sub.--1_T46 (SEQ ID NO:608). Table 83 below describes the starting and ending position of this segment on each transcript. TABLE-US-01106 TABLE 83 Segment location on transcripts Segment Segment ending Transcript name starting position position T46984_PEA_1_T2 (SEQ ID NO: 593) 3044 3110 T46984_PEA_T3 (SEQ ID NO: 594) 2438 2504 T46984_PEA_1_T12 (SEQ ID 1838 1904 NO: 595) T46984_PEA_1_T13 (SEQ ID 1869 1935 NO: 596) T46984_PEA_1_T14 (SEQ ID 1810 1876 NO: 597) T46984_PEA_1_T15 (SEQ ID 1727 1793 NO: 598) T46984_PEA_1_T19 (SEQ ID 3672 3738 NO: 599) T46984_PEA_1_T23 (SEQ ID 3044 3110 NO: 600) T46984_PEA_1_T27 (SEQ ID 1628 1694 NO: 601)

T46984_PEA_1_T32 (SEQ ID 1634 1700 NO: 602)
T46984_PEA_1_T35 (SEQ ID 1538 1604 NO: 604)
T46984_PEA_1_T46 (SEQ ID 1130 1196 NO: 608)

Segment cluster T46984_PEA.sub.--1_node.sub.--57 (SEQ ID NO:650) according to the present invention can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T35 (SEQ ID NO:604) and T46984_PEA.sub.--1_T46 (SEQ ID NO:608). Table 84 below describes the starting and ending position of this segment on each transcript. TABLE-US-01107 TABLE 84 Segment location on transcripts Segment Segment ending Transcript name starting position position T46984_PEA_1_T2 (SEQ ID NO: 593) 3111 3130 T46984_PEA_1_T3 (SEQ ID NO: 594) 2505 2524 T46984_PEA_1_T12 (SEQ ID 1905 1924 NO: 595) T46984_PEA_1_T13 (SEQ ID 1936 1955 NO: 596) T46984_PEA_1_T14 (SEQ ID 1877 1896 NO: 597) T46984_PEA_1_T15 (SEQ ID 1794 1813 NO: 598) T46984_PEA_1_T19 (SEQ ID 3739 3758 NO: 599) T46984_PEA_1_T23 (SEQ ID 3111 3130 NO: 600) T46984_PEA_1_T27 (SEQ ID 1695 1714 NO: 601) T46984_PEA_1_T32 (SEQ ID 1701 1720 NO: 602) T46984_PEA_1_T35 (SEQ ID 1605 1624 NO: 604) T46984_PEA_1_T46 (SEQ ID 1197 1216 NO: 608)

Segment cluster T46984_PEA.sub.--1_node.sub.--60 (SEQ ID NO:651) according to the present invention is supported by 326 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T27 (SEQ ID NO:601), T46984_PEA.sub.--1_T32 (SEQ ID NO:602), T46984_PEA.sub.--1_T35 (SEQ ID NO:604) and T46984_PEA.sub.--1_T46 (SEQ ID NO:608). Table 85 below describes the starting and ending position of this segment on each transcript. TABLE-US-01108 TABLE 85 Segment location on transcripts Segment Segment ending Transcript name starting position position T46984_PEA_1_T2 (SEQ ID NO: 593) 3131 3165 T46984_PEA_1_T3 (SEQ ID NO: 594) 2525 2559 T46984_PEA_1_T12 (SEQ ID 1925 1959 NO: 595) T46984_PEA_1_T13 (SEQ ID 1956 1990 NO: 596) T46984_PEA_1_T14 (SEQ ID 1897 1931 NO: 597) T46984_PEA_1_T15 (SEQ ID 1814 1848 NO: 598) T46984_PEA_1_T19 (SEQ ID 3759 3793 NO: 599) T46984_PEA_1_T27 (SEQ ID 1715 1749 NO: 601) T46984_PEA_1_T32 (SEQ ID 1721 1755 NO: 602) T46984_PEA_1_T35 (SEQ ID 1625 1659 NO: 604) T46984_PEA_1_T46 (SEQ ID 1217 1251 NO: 608)

Segment cluster T46984_PEA.sub.--1_node.sub.--62 (SEQ ID NO:652) according to the present invention is supported by 335 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T27 (SEQ ID NO:601), T46984_PEA.sub.--1_T32 (SEQ ID NO:602), T46984_PEA.sub.--1_T35 (SEQ ID NO:604) and T46984_PEA.sub.--1_T46 (SEQ ID NO:608). Table 86 below describes the starting and ending position of this segment on each transcript. TABLE-US-01109 TABLE 86 Segment location on transcripts Segment Segment ending Transcript name starting position position T46984_PEA_1_T2 (SEQ ID NO: 593) 3166 3226 T46984_PEA_1_T3 (SEQ ID NO: 594) 2560 620 T46984_PEA_1_T12 (SEQ ID 1960 2020 NO: 595) T46984_PEA_1_T13 (SEQ ID 1991 2051 NO: 596) T46984_PEA_1_T14 (SEQ ID 1932 1992 NO: 597) T46984_PEA_1_T15 (SEQ ID 1849 1909 NO: 598) T46984_PEA_1_T19 (SEQ ID 3794 3854 NO: 599) T46984_PEA_1_T27 (SEQ ID 1750 1810 NO: 601) T46984_PEA_1_T32 (SEQ ID 1756 1816 NO: 602) T46984_PEA_1_T35 (SEQ ID 1660 1720 NO: 604) T46984_PEA_1_T46 (SEQ ID 1252 1312 NO: 608)

Segment cluster T46984_PEA.sub.--1_node.sub.--66 (SEQ ID NO:653) according to the present invention is supported by 336 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T46 (SEQ ID NO:608), T46984_PEA.sub.--1_T47 (SEQ ID NO:609) and T46984_PEA.sub.--1_T51 (SEQ ID NO:611). Table 87 below describes the starting and ending position of this segment on each transcript. TABLE-US-01110 TABLE 87 Segment location on transcripts Segment Segment ending Transcript name starting position position T46984_PEA_1_T2 (SEQ ID NO: 593) 3227 3261 T46984_PEA_1_T3 (SEQ ID NO: 594) 2621 2655 T46984_PEA_1_T12 (SEQ ID 2021 2055 NO: 595) T46984_PEA_1_T13 (SEQ ID 2052 2086 NO: 596) T46984_PEA_1_T14 (SEQ ID 1993 2027 NO: 597) T46984_PEA_1_T15 (SEQ ID 1910 1944 NO: 598) T46984_PEA_1_T19 (SEQ ID 3855 3889 NO: 599) T46984_PEA_1_T23 (SEQ ID 3131 3165 NO: 600) T46984_PEA_1_T27 (SEQ ID 1811 1845 NO: 601) T46984_PEA_1_T32 (SEQ ID 1817 1851 NO: 602) T46984PEA_1_T34 (SEQ ID 1563 1597 NO: 603) T46984_PEA_1_T35 (SEQ ID 1721 1755 NO: 604) T46984_PEA_1_T46 (SEQ ID 1313 1347 NO: 608) T46984_PEA_1_T47 (SEQ ID 752 786 NO: 609) T46984_PEA_1_T51 (SEQ ID 349 383 NO: 611)

Segment cluster T46984_PEA.sub.--1_node.sub.--67 (SEQ ID NO:654) according to the present invention is supported by 323 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596),
T46984_PEA.sub.--1_T14 (SEQ ID NO:597),
T46984_PEA.sub.--1_T15 (SEQ ID NO:598),
T46984_PEA.sub.--1_T19 (SEQ ID NO:599),
T46984_PEA.sub.--1_T23 (SEQ ID NO:600),
T46984_PEA.sub.--1_T27 (SEQ ID NO:601),
T46984_PEA.sub.--1_T32 (SEQ ID NO:602),
T46984_PEA.sub.--1_T34 (SEQ ID NO:603),
T46984_PEA.sub.--1_T35 (SEQ ID NO:604),
T46984_PEA.sub.--1_T46 (SEQ ID NO:608),
T46984_PEA.sub.--1_T47 (SEQ ID NO:609) and
T46984_PEA.sub.--1_T51 (SEQ ID NO:611). Table 88 below describes the starting and ending position of this segment on each transcript. TABLE-US-01111 TABLE 88 Segment location on transcripts Segment Segment ending Transcript name starting position position T46984_PEA__1_T2 (SEQ ID NO: 593) 3262 3302 T46984_PEA__1_T3 (SEQ ID NO: 594) 2656 2696 T46984_PEA__1_T12 (SEQ ID 2056 2096 NO: 595) T46984_PEA__1_T13 (SEQ ID 2087 2127 NO: 596) T46984_PEA__1_T14 (SEQ ID 2028 2068 NO: 597) T46984_PEA__1_T15 (SEQ ID 1945 1985 NO: 598) T46984_PEA__1_T19 (SEQ ID 3890 3930 NO: 599) T46984_PEA__1_T23 (SEQ ID 3166 3206 NO: 600) T46984 _PEA__1_T27 (SEQ ID 1846 1886 NO: 601) T46984_PEA__1_T32 (SEQ ID 1852 1892 NO: 602) T46984_PEA__1_T34 (SEQ ID 1598 1638 NO: 603) T46984_PEA__1_T35 (SEQ ID 1756 1796 NO: 604) T46984_PEA__1_T46 (SEQ ID 1348 1388 NO: 608) T46984_PEA__1_T47 (SEQ ID 787 827 NO: 609) T46984_PEA__1_T51 (SEQ ID 384 424 NO: 611)

Segment cluster T46984_PEA.sub.--1_node.sub.--70 (SEQ ID NO:655) according to the present invention is supported by 337 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594),
T46984_PEA.sub.--1_T12 (SEQ ID NO:595),
T46984_PEA.sub.--1_T13 (SEQ ID NO:596),
T46984_PEA.sub.--1_T14 (SEQ ID NO:597),
T46984_PEA.sub.--1_T15 (SEQ ID NO:598),
T46984_PEA.sub.--1_T19 (SEQ ID NO:599),
T46984_PEA.sub.--1_T23 (SEQ ID NO:600),
T46984_PEA.sub.--1_T27 (SEQ ID NO:601),
T46984_PEA.sub.--1_T32 (SEQ ID NO:602),
T46984_PEA.sub.--1_T34 (SEQ ID NO:603),
T46984_PEA.sub.--1_T35 (SEQ ID NO:604),
T46984_PEA.sub.--1_T46 (SEQ ID NO:608),
T46984_PEA.sub.--1_T47 (SEQ ID NO:609),
T46984_PEA.sub.--1_T51 (SEQ ID NO:611),
T46984_PEA.sub.--1_T52 (SEQ ID NO:612) and
T46984_PEA.sub.--1_T54 (SEQ ID NO:613). Table 89 below describes the starting and ending position of this segment on each transcript. TABLE-US-01112 TABLE 89 Segment location on transcripts Segment Segment ending Transcript name starting position position T46984_PEA__1_T2 (SEQ ID NO: 593) 3303 3377 T46984_PEA__1_T3 (SEQ ID NO: 594) 2697 2771 T46984_PEA__1_T12 (SEQ ID 2097 2171 NO: 595) T46984_PEA__1_T13 (SEQ ID 2128 2202 NO: 596) T46984_PEA__1_T14 (SEQ ID 2069 2143 NO: 597) T46984_PEA__1_T15 (SEQ ID 1986 2060 NO: 598) T46984_PEA__1_T19 (SEQ ID 3931 4005 NO: 599) T46984_PEA__1_T23 (SEQ ID 3207 3281 NO: 600) T46984_PEA__1_T27 (SEQ ID 1887 1961 NO: 601) T46984_PEA__1_T32 (SEQ ID 1893 1967 NO: 602) T46984_PEA__1_T34 (SEQ ID 1639 1713 NO: 603) T46984_PEA__1_T35 (SEQ ID 1797 1871 NO: 604) T46984_PEA__1_T46 (SEQ ID 1389 1463 NO: 608) T46984_PEA__1_T47 (SEQ ID 828 902 NO: 609) T46984_PEA__1_T51 (SEQ ID 425 499 NO: 611) T46984_PEA__1_T52 (SEQ ID 928 1002 NO: 612) T46984_PEA__1_T54 (SEQ ID 928 1002 NO: 613)

Segment cluster T46984_PEA.sub.--1_node.sub.--71 (SEQ ID NO:656) according to the present invention can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595),
T46984_PEA.sub.--1_T13 (SEQ ID NO:596),
T46984_PEA.sub.--1_T14 (SEQ ID NO:597),
T46984_PEA.sub.--1_T15 (SEQ ID NO:598),
T46984_PEA.sub.--1_T19 (SEQ ID NO:599),
T46984_PEA.sub.--1_T23 (SEQ ID NO:600),
T46984_PEA.sub.--1_T27 (SEQ ID NO:601),
T46984_PEA.sub.--1_T32 (SEQ ID NO:602),
T46984_PEA.sub.--1_T34 (SEQ ID NO:603),
T46984_PEA.sub.--1_T35 (SEQ ID NO:604),
T46984_PEA.sub.--1_T46 (SEQ ID NO:608),
T46984_PEA.sub.--1_T47 (SEQ ID NO:609),
T46984_PEA.sub.--1_T51 (SEQ ID NO:611),
T46984_PEA.sub.--1_T52 (SEQ ID NO:612) and
T46984_PEA.sub.--1_T54 (SEQ ID NO:613). Table 90 below describes the starting and ending position of this segment on each transcript. TABLE-US-01113 TABLE 90 Segment location on transcripts Segment Segment ending Transcript name starting position position T46984_PEA__1_T2 (SEQ ID NO: 593) 3378 3399 T46984_PEA__1_T3 (SEQ ID NO: 594) 2772 2793 T46984_PEA__1_T12 (SEQ ID 2172 2193 NO: 595) T46984_PEA__1_T13 (SEQ ID 2203 2224 NO: 596) T46984_PEA__1_T14 (SEQ ID 2144 2165 NO: 597) T46984_PEA__1_T15 (SEQ ID 2061 2082 NO: 598) T46984_PEA__1_T19 (SEQ ID 4006 4027 NO: 599) T46984_PEA__1_T23 (SEQ ID 3282 3303 NO: 600) T46984_PEA__1_T27 (SEQ ID 1962 1983 NO: 601) T46984_PEA __1_T32 (SEQ ID 1968 1989 NO: 602) T46984_PEA__1_T34 (SEQ ID 1714 1735 NO: 603) T46984_PEA__1_T35 (SEQ ID 1872 1893 NO: 604) T46984_PEA__1_T46 (SEQ ID 1464 1485 NO: 608) T46984_PEA__1_T47 (SEQ ID 903 924 NO: 609) T46984_PEA__1_T51 (SEQ ID 500 521 NO: 611) T46984_PEA__1_T52 (SEQ ID 1003 1024 NO: 612) T46984_PEA__1_T54 (SEQ ID 1003 1024 NO: 613)

Segment cluster T46984_PEA.sub.--1_node.sub.--72 (SEQ ID NO:657) according to the present invention can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595),
T46984_PEA.sub.--1_T13 (SEQ ID NO:596),
T46984_PEA.sub.--1_T14 (SEQ ID NO:597),
T46984_PEA.sub.--1_T15 (SEQ ID NO:598),
T46984_PEA.sub.--1_T19 (SEQ ID NO:599),
T46984_PEA.sub.--1_T23 (SEQ ID NO:600),
T46984_PEA.sub.--1_T27 (SEQ ID NO:601),
T46984_PEA.sub.--1_T32 (SEQ ID NO:602),
T46984_PEA.sub.--1_T34 (SEQ ID NO:603),
T46984_PEA.sub.--1_T35 (SEQ ID NO:604),
T46984_PEA.sub.--1_T43 (SEQ ID NO:607),
T46984_PEA.sub.--1_T46 (SEQ ID NO:608),
T46984_PEA.sub.--1_T47 (SEQ ID NO:609),
T46984_PEA.sub.--1_T51 (SEQ ID NO:611),
T46984_PEA.sub.--1_T52 (SEQ ID NO:612) and
T46984_PEA.sub.--1_T54 (SEQ ID NO:613). Table 91 below describes the starting and ending position of this segment on each transcript. TABLE-US-01114 TABLE 91 Segment location on transcripts Segment Segment ending Transcript name starting position position T46984_PEA__1_T2

(SEQ ID NO: 593) 3400 3421 T46984_PEA_1_T3 (SEQ ID NO: 594) 2794 2815 T46984_PEA_1_T12 (SEQ ID 2194 2215 NO: 595) T46984_PEA_1_T13 (SEQ ID 2225 2246 NO: 596) T46984_PEA_1_T14 (SEQ ID 2166 2187 NO: 597) T46984_PEA_1_T15 (SEQ ID 2083 2104 NO: 598) T46984_PEA_1_T19 (SEQ ID 4028 4049 NO: 599) T46984_PEA_1_T23 (SEQ ID 3304 3325 NO: 600) T46984_PEA_1_T27 (SEQ ID 1984 2005 NO: 601) T46984_PEA_1_T32 (SEQ ID 1990 2011 NO: 602) T46984_PEA_1_T34 (SEQ ID 1736 1757 NO: 603) T46984_PEA_1_T35 (SEQ ID 1894 1915 NO: 604) T46984_PEA_1_T43 (SEQ ID 1172 1193 NO: 607) T46984_PEA_1_T46 (SEQ ID 1486 1507 NO: 608) T46984_PEA_1_T47 (SEQ ID 925 946 NO: 609) T46984_PEA_1_T51 (SEQ ID 522 543 NO: 611) T46984_PEA_1_T52 (SEQ ID 1025 1046 NO: 612) T46984_PEA_1_T54 (SEQ ID 1025 1046 NO: 613)

Segment cluster T46984_PEA.sub.--1_node.sub.--73 (SEQ ID NO:658) according to the present invention can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T43 (SEQ ID NO:607), T46984_PEA.sub.--1_T46 (SEQ ID NO:608), T46984_PEA.sub.--1_T47 (SEQ ID NO:609), T46984_PEA.sub.--1_T51 (SEQ ID NO:611), T46984_PEA.sub.--1_T52 (SEQ ID NO:612) and T46984_PEA.sub.--1_T54 (SEQ ID NO:613). Table 92 below describes the starting and ending position of this segment on each transcript. TABLE-US-01115 TABLE 92 Segment location on transcripts Segment Segment Transcript name starting position ending position T46984_PEA_1_T2 3422 3428 (SEQ ID NO: 593) T46984_PEA_1_T3 2816 2822 (SEQ ID NO: 594) T46984_PEA_1_T12 (SEQ ID 2216 2222 NO: 595) T46984_PEA_1_T13 (SEQ ID 2247 2253 NO: 596) T46984_PEA_1_T14 (SEQ ID 2188 2194 NO: 597) T46984_PEA_1_T15 (SEQ ID 2105 2111 NO: 598) T46984_PEA_1_T19 (SEQ ID 4050 4056 NO: 599) T46984_PEA_1_T23 (SEQ ID 3326 3332 NO: 600) T46984_PEA_1_T27 (SEQ ID 2006 2012 NO: 601) T46984_PEA_1_T32 (SEQ ID 2012 2018 NO: 602) T46984_PEA_1_T34 (SEQ ID 1758 1764 NO: 603) T46984_PEA_1_T35 (SEQ ID 1916 1922 NO: 604) T46984_PEA_1_T43 (SEQ ID 1194 1200 NO: 607) T46984_PEA_1_T46 (SEQ ID 1508 1514 NO: 608) T46984_PEA_1_T47 (SEQ ID 947 953 NO: 609) T46984_PEA_1_T51 (SEQ ID 544 550 NO: 611) T46984_PEA_1_T52 (SEQ ID 1047 1053 NO: 612) T46984_PEA_1_T54 (SEQ ID 1047 1053 NO: 613)

Segment cluster T46984_PEA.sub.--1_node.sub.--74 (SEQ ID NO:659) according to the present invention can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T14 (SEQ ID NO:597), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T43 (SEQ ID NO:607), T46984_PEA.sub.--1_T46 (SEQ ID NO:608), T46984_PEA.sub.--1_T47 (SEQ ID NO:609), T46984_PEA.sub.--1_T51 (SEQ ID NO:611), T46984_PEA.sub.--1_T52 (SEQ ID NO:612) and T46984_PEA.sub.--1_T54 (SEQ ID NO:613). Table 93 below describes the starting and ending position of this segment on each transcript. TABLE-US-01116 TABLE 93 Segment location on transcripts Segment Segment Transcript name starting position ending position T46984_PEA_1_T2 3429 3432 (SEQ ID NO: 593) T46984_PEA_1_T3 2823 2826 (SEQ ID NO: 594) T46984_PEA_1_T12 (SEQ ID 2223 2226 NO: 595) T46984_PEA_1_T13 (SEQ ID 2254 2257 NO: 596) T46984_PEA_1_T14 (SEQ ID 2195 2198 NO: 597) T46984_PEA_1_T15 (SEQ ID 2112 2115 NO: 598) T46984_PEA_1_T19 (SEQ ID 4057 4060 NO: 599) T46984_PEA_1_T23 (SEQ ID 3333 3336 NO: 600) T46984_PEA_1_T27 (SEQ ID 2013 2016 NO: 601) T46984_PEA_1_T32 (SEQ ID 2019 2022 NO: 602) T46984_PEA_1_T34 (SEQ ID 1765 1768 NO: 603) T46984_PEA_1_T35 (SEQ ID 1923 1926 NO: 604) T46984_PEA_1_T43 (SEQ ID 1201 1204 NO: 607) T46984_PEA_1_T46 (SEQ ID 1515 1518 NO: 608) T46984_PEA_1_T47 (SEQ ID 954 957 NO: 609) T46984_PEA_1_T51 (SEQ ID 551 554 NO: 611) T46984_PEA_1_T52 (SEQ ID 1054 1057 NO: 612) T46984_PEA_1_T54 (SEQ ID 1054 1057 NO: 613)

Segment cluster T46984_PEA.sub.--1_node.sub.--83 (SEQ ID NO:660) according to the present invention can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T43 (SEQ ID NO:607), T46984_PEA.sub.--1_T46 (SEQ ID NO:608), T46984_PEA.sub.--1_T47 (SEQ ID NO:609), T46984_PEA.sub.--1_T51 (SEQ ID NO:611), T46984_PEA.sub.--1_T52 (SEQ ID NO:612) and T46984_PEA.sub.--1_T54 (SEQ ID NO:613). Table 94 below describes the starting and ending position of this segment on each transcript. TABLE-US-01117 TABLE 94 Segment location on transcripts Segment Segment Transcript name starting position ending position T46984_PEA_1_T2 (SEQ ID NO: 3433 3437 593) T46984_PEA_1_T3 (SEQ ID NO: 2827 2831 594) T46984_PEA_1_T12 (SEQ ID 2227 2231 NO: 595) T46984_PEA_1_T13 (SEQ ID 2258 2262 NO: 596) T46984_PEA_1_T15 (SEQ ID 2116 2120 NO: 598) T46984_PEA_1_T19 (SEQ ID 4061 4065 NO: 599) T46984_PEA_1_T23 (SEQ ID 3337 3341 NO: 600) T46984_PEA_1_T27 (SEQ ID 2017 2021 NO: 601) T46984_PEA_1_T32 (SEQ ID 2023 2027 NO: 602) T46984 _PEA_1_T34 (SEQ ID 1769 1773 NO: 603) T46984_PEA_1_T35 (SEQ ID 1927 1931 NO: 604) T46984_PEA_1_T43 (SEQ ID 1205 1209 NO: 607) T46984_PEA_1_T46 (SEQ ID 1519 1523 NO: 608).

T46984_PEA__1_T47 (SEQ ID NO: 609)
T46984_PEA__1_T51 (SEQ ID NO: 611)
T46984_PEA__1_T52 (SEQ ID NO: 612)
T46984_PEA__1_T54 (SEQ ID NO: 613)

Segment cluster T46984_PEA.sub.--1_node.sub.--84 (SEQ ID NO:661) according to the present invention can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T43 (SEQ ID NO:607), T46984_PEA.sub.--1_T46 (SEQ ID NO:608), T46984_PEA.sub.--1_T47 (SEQ ID NO:609), T46984_PEA.sub.--1_T51 (SEQ ID NO:611), T46984_PEA.sub.--1_T52 (SEQ ID NO:612) and T46984_PEA.sub.--1_T54 (SEQ ID NO:613). Table 95 below describes the starting and ending position of this segment on each transcript.

TABLE-US-01118 TABLE 95 Segment location on transcripts

| Segment name | Segment starting position | Segment ending position | Transcript |
|---|---|---|---|
| T46984_PEA__1_T2 | 3438 | 3451 | (SEQ ID NO: 593) |
| T46984_PEA__1_T3 | 2832 | 2845 | (SEQ ID NO: 594) |
| T46984_PEA__1_T12 | 2232 | 2245 | (SEQ ID NO: 595) |
| T46984_PEA__1_T13 | 2263 | 2276 | (SEQ ID NO: 596) |
| T46984_PEA__1_T15 | 2121 | 2134 | (SEQ ID NO: 598) |
| T46984_PEA__1_T19 | 4066 | 4079 | (SEQ ID NO: 599) |
| T46984_PEA__1_T23 | 3342 | 3355 | (SEQ ID NO: 600) |
| T46984_PEA__1_T27 | 2022 | 2035 | (SEQ ID NO: 601) |
| T46984_PEA__1_T32 | 2028 | 2041 | (SEQ ID NO: 602) |
| T46984_PEA__1_T34 | 1774 | 1787 | (SEQ ID NO: 603) |
| T46984_PEA__1_T35 | 1932 | 1945 | (SEQ ID NO: 604) |
| T46984_PEA__1_T43 | 1210 | 1223 | (SEQ ID NO: 607) |
| T46984_PEA__1_T46 | 1524 | 1537 | (SEQ ID NO: 608) |
| T46984_PEA__1_T47 | 963 | 976 | (SEQ ID NO: 609) |
| T46984_PEA__1_T51 | 560 | 573 | (SEQ ID NO: 611) |
| T46984_PEA__1_T52 | 1063 | 1076 | (SEQ ID NO: 612) |
| T46984_PEA__1_T54 | 1063 | 1076 | (SEQ ID NO: 613) |

Segment cluster T46984_PEA.sub.--1_node.sub.--85 (SEQ ID NO:662) according to the present invention is supported by 295 libraries. The number of libraries was determined as previously described. This segment can be found in the following transcript(s): T46984_PEA.sub.--1_T2 (SEQ ID NO:593), T46984_PEA.sub.--1_T3 (SEQ ID NO:594), T46984_PEA.sub.--1_T12 (SEQ ID NO:595), T46984_PEA.sub.--1_T13 (SEQ ID NO:596), T46984_PEA.sub.--1_T15 (SEQ ID NO:598), T46984_PEA.sub.--1_T19 (SEQ ID NO:599), T46984_PEA.sub.--1_T23 (SEQ ID NO:600), T46984_PEA.sub.--1_T27 (SEQ ID NO:601), T46984_PEA.sub.--1_T32 (SEQ ID NO:602), T46984_PEA.sub.--1_T34 (SEQ ID NO:603), T46984_PEA.sub.--1_T35 (SEQ ID NO:604), T46984_PEA.sub.--1_T43 (SEQ ID NO:607), T46984_PEA.sub.--1_T46 (SEQ ID NO:608), T46984_PEA.sub.--1_T47 (SEQ ID NO:609), T46984_PEA.sub.--1_T51 (SEQ ID NO:611), T46984_PEA.sub.--1_T52 (SEQ ID NO:612) and T46984_PEA.sub.--1_T54 (SEQ ID NO:613). Table 96 below describes the starting and ending position of this segment on each transcript.

TABLE-US-01119 TABLE 96 Segment location on transcripts

| Segment name | Segment starting position | Segment ending position | Transcript |
|---|---|---|---|
| T46984_PEA__1_T2 | 3452 | 3491 | (SEQ ID NO: 593) |
| T46984_PEA__1_T3 | 2846 | 2885 | (SEQ ID NO: 594) |
| T46984_PEA__1_T12 | 2246 | 2285 | (SEQ ID NO: 595) |
| T46984_PEA__1_T13 | 2277 | 2316 | (SEQ ID NO: 596) |
| T46984_PEA__1_T15 | 2135 | 2174 | (SEQ ID NO: 598) |
| T46984_PEA__1_T19 | 4080 | 4119 | (SEQ ID NO: 599) |
| T46984_PEA__1_T23 | 3356 | 3395 | (SEQ ID NO: 600) |
| T46984_PEA__1_T27 | 2036 | 2075 | (SEQ ID NO: 601) |
| T46984_PEA__1_T32 | 2042 | 2081 | (SEQ ID NO: 602) |
| T46984_PEA__1_T34 | 1788 | 1827 | (SEQ ID NO: 603) |
| T46984_PEA__1_T35 | 1946 | 1985 | (SEQ ID NO: 604) |
| T46984_PEA__1_T43 | 1224 | 1263 | (SEQ ID NO: 607) |
| T46984_PEA__1_T46 | 1538 | 1577 | (SEQ ID NO: 608) |
| T46984_PEA__1_T47 | 977 | 1016 | (SEQ ID NO: 609) |
| T46984_PEA__1_T51 | 574 | 613 | (SEQ ID NO: 611) |
| T46984_PEA__1_T52 | 1077 | 1116 | (SEQ ID NO: 612) |
| T46984_PEA__1_T54 | 1077 | 1116 | (SEQ ID NO: 613) |

Variant protein alignment to the previously known protein:

Sequence name: RIB2_HUMAN (SEQ ID NO:663)

Sequence documentation:

Alignment of: T46984_PEA.sub.--1_P2 (SEQ ID NO:664).times.RIB2_HUMAN (SEQ ID NO:663)

Alignment segment 1/1: TABLE-US-011 20 Quality: 4716.00 Escore: 0 Matching length: 498 Total length: 498 Matching Percent 100.00 Matching Percent Identity: 100.00 Similarity: Total Percent Similarity: 100.00 Total Percent Identity: 100.00 Gaps: 0

```
Alignment: TABLE-US-01121 1
MAPPGSSTVFLLALTIIASTWALTPTHYLTKHDVERLKASLDRPFTNLES    50
|||||||||||||||||||||||||||||||||||||||||||||||||     1
MAPPGSSTVFLLALTIIASTWALTPTHYLTKHDVERLKASLDRPFTNLES    50  51

AFYSIVGLSSLGAQVPDAKKACTYIRSNLDPSNVDSLFYAAQASQALSGC   100
|||||||||||||||||||||||||||||||||||||||||||||||||    51
AFYSIVGLSSLGAQVPDAKKACTYIRSNLDPSNVDSLFYAAQASQALSGC   100 101

EISISNETKDLLLAAVSEDSSVTQIYHAVAALSGFGLPLASQEALSALTA   150
|||||||||||||||||||||||||||||||||||||||||||||||||   101
EISISNETKDLLLAAVSEDSSVTQIYHAVAALSGFGLPLASQEALSALTA   150 151

RLSKEETVLATVQALQTASHLSQQADLRSIVEEIEDLVARLDELGGVYLQ   200
|||||||||||||||||||||||||||||||||||||||||||||||||   151
RLSKEETVLATVQALQTASHLSQQADLRSIVEEIEDLVARLDELGGVYLQ   200 201

FEEGLETTALFVAATYKLMDHVGTEPSIKEDQVIQLMNAIFSKKNFESLS   250
|||||||||||||||||||||||||||||||||||||||||||||||||   201
FEEGLETTALFVAATYKLMDHVGTEPSIKEDQVIQLMNAIFSKKNFESLS   250 251
```

```
EAFSVASAAAVLSHNRYHVPVVVVPEGSASDTHEQAILRLQVTNVLSQPL    300
|||||||||||||||||||||||||||||||||||||||||||||||||    251
EAFSVASAAAVLSHNRYHVPVVVVPEGSASDTHEQAILRLQVTNVLSQPL    300 301

TQATVKLEHAKSVASRATVLQKTSFTPVGDVFELNFMNVKFSSGYYDFLV    350
|||||||||||||||||||||||||||||||||||||||||||||||||    301
TQATVKLEHAKSVASRATVLQKTSFTPVGDVFELNFMNVKFSSGYYDFLV    350 351

EVEGDNRYIANTVELRVKISTEVGITNVDLSTVDKDQSIAPKTTRVTYPA    400
|||||||||||||||||||||||||||||||||||||||||||||||||    351
EVEGDNRYIANTVELRVKISTEVGITNVDLSTVDKDQSIAPKTTRVTYPA    400 401

KAKGTFIADSHQNFALFFQLVDVNTGAELTPHQTFVRLHNQKTGQEVVFV    450
|||||||||||||||||||||||||||||||||||||||||||||||||    401
KAKGTFIADSHQNFALFFQLVDVNTGAELTPHQTFVRLHNQKTGQEVVFV    450 451

AEPDNKNVYKFELDTSERKIEFDSASGTYTLYLIIGDATLKNPILWNV      498
|||||||||||||||||||||||||||||||||||||||||||||||      451
AEPDNKNVYKFELDTSERKIEFDSASGTYTLYLIIGDATLKNPILWNV      498
```

Sequence name: RIB2_HUMAN (SEQ ID NO:663)

Sequence documentation:

Alignment of: T46984_PEA.sub.--1_P3 (SEQ ID NO:665).times.RIB2_HUMAN (SEQ ID NO:663).

Alignment segment 1/1: TABLE-US-01122 Quality: 4085.00 Escore: 0 Matching length: 433 Total length: 433 Matching Percent 100.00 Matching Percent Identity: 100.00 Similarity: Total Percent Similarity: 100.00 Total Percent Identity: 100.00 Gaps: 0

Alignment:

Sequence name: RIB2_HUMAN (SEQ ID NO:663)

Sequence documentation:

Alignment of: T46984_PEA.sub.--1_P10 (SEQ ID NO:666).times.RIB2_HUMAN (SEQ ID NO:663).

Alignment segment 1/1: TABLE-US-01123 Quality: 4716.00 Escore: 0 Matching length: 498 Total length: 498 Matching Percent 100.00 Matching Percent Identity: 100.00 Similarity: Total Percent Similarity: 100.00 Total Percent Identity: 100.00 Gaps: 0

```
Alignment: TABLE-US-01124 1
MAPPGSSTVFLLALTIIASTWALTPTHYLTKHDVERLKASLDRPFTNLES    50
|||||||||||||||||||||||||||||||||||||||||||||||||    1
MAPPGSSTVFLLALTIIASTWALTPTHYLTKHDVERLKASLDRPFTNLES    50  51

AFYSIVGLSSLGAQVPDAKKACTYIRSNLDPSNVDSLFYAAQASQALSGC    100
|||||||||||||||||||||||||||||||||||||||||||||||||    51
AFYSIVGLSSLGAQVPDAKKACTYIRSNLDPSNVDSLFYAAQASQALSGC    100 101

EISISNETKDLLLAAVSEDSSVTQIYHAVAALSGFGLPLASQEALSALTA    150
|||||||||||||||||||||||||||||||||||||||||||||||||    101
EISISNETKDLLLAAVSEDSSVTQIYHAVAALSGFGLPLASQEALSALTA    150 151

RLSKEETVLATVQALQTASHLSQQADLRSIVEEIEDLVARLDELGGVYLQ    200
|||||||||||||||||||||||||||||||||||||||||||||||||    151
RLSKEETVLATVQALQTASHLSQQADLRSIVEEIEDLVARLDELGGVYLQ    200 201

FEEGLETTALFVAATYKLMDHVGTEPSIKEDQVIQLMNAIFSKKNFESLS    250
|||||||||||||||||||||||||||||||||||||||||||||||||    201
FEEGLETTALFVAATYKLMDHVGTEPSIKEDQVIQLMNAIFSKKNFESLS    250 251

EAFSVASAAAVLSHNRYHVPVVVVPEGSASDTHEQAILRLQVTNVLSQPL    300
|||||||||||||||||||||||||||||||||||||||||||||||||    251
EAFSVASAAAVLSHNRYHVPVVVVPEGSASDTHEQAILRLQVTNVLSQPL    300 301

TQATVKLEHAKSVASRATVLQKTSFTPVGDVFELNFMNVKFSSGYYDFLV    350
|||||||||||||||||||||||||||||||||||||||||||||||||    301
TQATVKLEHAKSVASRATVLQKTSFTPVGDVFELNFMNVKFSSGYYDFLV    350 351

EVEGDNRYIANTVELRVKISTEVGITNVDLSTVDKDQSIAPKTTRVTYPA    400
|||||||||||||||||||||||||||||||||||||||||||||||||    351
EVEGDNRYIANTVELRVKISTEVGITNVDLSTVDKDQSIAPKTTRVTYPA    400 401

KAKGTFIADSHQNFALFFQLVDVNTGAELTPHQTFVRLHNQKTGQEVVFV    450
|||||||||||||||||||||||||||||||||||||||||||||||||    401
KAKGTFIADSHQNFALFFQLVDVNTGAELTPHQTFVRLHNQKTGQEVVFV    450 451

AEPDNKNVYKFELDTSERKIEFDSASGTYTLYLIIGDATLKNPILWNV      498
|||||||||||||||||||||||||||||||||||||||||||||||      451
AEPDNKNVYKFELDTSERKIEFDSASGTYTLYLIIGDATLKNPILWNV      498
```

Sequence name: RIB2_HUMAN (SEQ ID NO:663)

Sequence documentation:

Alignment of: T46984_PEA.sub.--1_P11 (SEQ ID NO:667).times.RIB2_HUMAN (SEQ ID NO:663).

Alignment segment 1/1: TABLE-US-01125 Quality: 5974.00 Escore: 0 Matching length: 628 Total length: 628 Matching Percent 100.00 Matching Percent Identity: 100.00 Similarity: Total Percent Similarity: 100.00 Total Percent Identity: 100.00 Gaps: 0

Alignment:
Sequence name: RIB2_HUMAN (SEQ ID NO:663)

Sequence documentation:

Alignment of: T46984_PEA.sub.--1_P21 (SEQ ID NO:669).times.RIB2_HUMAN (SEQ ID NO:663).

Alignment segment 1/1: TABLE-US-01127 Quality: 5348.00 Escore: 0 Matching length: 562 Total length: 562 Matching Percent 100.00 Matching Percent Identity: 100.00 Similarity: Total Percent Similarity: 100.00 Total Percent Identity: 100.00 Gaps: 0

```
Alignment TABLE-US-01128 2
KACTYIRSNLDPSNVDSLFYAAQASQALSGCEISISNETKDLLLAAVSED         51
|||||||||||||||||||||||||||||||||||||||||||||||||          70
KACTYIRSNLDPSNVDSLFYAAQASQALSGCEISISNETKDLLLAAVSED        119  52

SSVTQIYHAVAALSGFGLPLASQEALSALTARLSKEETVLATVQALQTAS        101
|||||||||||||||||||||||||||||||||||||||||||||||||         120
SSVTQIYHAVAALSGFGLPLASQEALSALTARLSKEETVLATVQALQTAS        169 102

HLSQQADLRSIVEEIEDLVARLDELGGVYLQFEEGLETTALFVAATYKLM        151
|||||||||||||||||||||||||||||||||||||||||||||||||         170
HLSQQADLRSIVEEIEDLVARLDELGGVYLQFEEGLETTALFVAATYKLM        219 152

DHVGTEPSIKEDQVIQLMNAIFSKKNFESLSEAFSVASAAAVLSHNRYHV        201
|||||||||||||||||||||||||||||||||||||||||||||||||         220
DHVGTEPSIKEDQVIQLMNAIFSKKNFESLSEAFSVASAAAVLSHNRYHV        269 202

PVVVVPEGSASDTHEQAILRLQVTNVLSQPLTQATVKLEHAKSVASRATV        251
|||||||||||||||||||||||||||||||||||||||||||||||||         270
PVVVVPEGSASDTHEQAILRLQVTNVLSQPLTQATVKLEHAKSVASRATV        319 252

LQKTSFTPVGDVFELNFMNVKFSSGYYDFLVEVEGDNRYIANTVELRVKI        301
|||||||||||||||||||||||||||||||||||||||||||||||||         320
LQKTSFTPVGDVFELNFMNVKFSSGYYDFLVEVEGDNRYIANTVELRVKI        369 302

STEVGITNVDLSTVDKDQSIAPKTTRVTYPAKAKGTFIADSHQNFALFFQ        351
|||||||||||||||||||||||||||||||||||||||||||||||||         370
STEVGITNVDLSTVDKDQSIAPKTTRVTYPAKAKGTFIADSHQNFALFFQ        419 352

LVDVNTGAELTPHQTFVRLHNQKTGQEVVFVAEPDNKNVYKFELDTSERK        401
|||||||||||||||||||||||||||||||||||||||||||||||||         420
LVDVNTGAELTPHQTFVRLHNQKTGQEVVFVAEPDNKNVYKFELDTSERK        469 402

IEFDSASGTYTLYLIIGDATLKNPILWNVADVVIKFPEEEAPSTVLSQNL        451
|||||||||||||||||||||||||||||||||||||||||||||||||         470
IEFDSASGTYTLYLIIGDATLKNPILWNVADVVIKFPEEEAPSTVLSQNL        519 452

FTPKQEIQHLFREPEKRPPTVVSNTFTALILSPLLLLFALWIRIGANVSN        501
|||||||||||||||||||||||||||||||||||||||||||||||||         520
FTPKQEIQHLFREPEKRPPTVVSNTFTALILSPLLLLFALWIRIGANVSN        569 502

FTFAPSTIIFHLGHAAMLGLMYVYWTQLNMFQTLKYLAILGSVTFLAGNR        551
|||||||||||||||||||||||||||||||||||||||||||||||||         570
FTFAPSTIIFHLGHAAMLGLMYVYWTQLNMFQTLKYLAILGSVTFLAGNR        619 552

MLAQQAVKRTAH                                              563
||||||||||||                                              620
MLAQQAVKRTAH                                              631
```

Alignment:
Sequence name: RIB2_HUMAN (SEQ ID NO:663)
Sequence documentation:
Alignment of: T46984_PEA.sub.--1_P12 (SEQ ID NO:668).times.RIB2_HUMAN (SEQ ID NO:663).

Alignment segment 1/1: TABLE-US-01126 Quality: 3179.00 Escore: 0 Matching length: 338 Total length: 338 Matching Percent 100.00 Matching Percent Identity: 100.00 Similarity: Total Percent Similarity: 100.00 Total Percent Identity: 100.00 Gaps: 0

Sequence name: RIB2_HUMAN (SEQ ID NO:663)
Sequence documentation:
Alignment of: T46984_PEA.sub.--1_P27 (SEQ ID NO:670).times.RIB2_HUMAN (SEQ ID NO:663).

Alignment segment 1/1: TABLE-US-01129 Quality: 3910.00 Escore: 0 Matching length: 415 Total length: 415 Matching Percent 100.00 Matching Percent Identity: 100.00 Similarity: Total Percent Similarity: 100.00 Total Percent Identity: 100.00 Gaps: 0

```
Alignment TABLE-US-01130 1
MAPPGSSTVFLLALTIIASTWALTPTHYLTKHDVERLKASLDRPFTNLES          50
||||||||||||||||||||||||||||||||||||||||||||||||||          1
MAPPGSSTVFLLALTIIASTWALTPTHYLTKHDVERLKASLDRPFTNLES          50   51

AFYSIVGLSSLGAQVPDAKKACTYIRSNLDPSNVDSLFYAAQASQALSGC         100
||||||||||||||||||||||||||||||||||||||||||||||||||         51
AFYSIVGLSSLGAQVPDAKKACTYIRSNLDPSNVDSLFYAAQASQALSGC         100  101

EISISNETKDLLLAAVSEDSSVTQIYHAVAALSGFGLPLASQEALSALTA         150
||||||||||||||||||||||||||||||||||||||||||||||||||         101
EISISNETKDLLLAAVSEDSSVTQIYHAVAALSGFGLPLASQEALSALTA         150  151

RLSKEETVLATVQALQTASHLSQQADLRSIVEEIEDLVARLDELGGVYLQ         200
||||||||||||||||||||||||||||||||||||||||||||||||||         151
RLSKEETVLATVQALQTASHLSQQADLRSIVEEIEDLVARLDELGGVYLQ         200  201

FEEGLETTALFVAATYKLMDHVGTEPSIKEDQVIQLMNAIFSKKNFESLS         250
||||||||||||||||||||||||||||||||||||||||||||||||||         201
FEEGLETTALFVAATYKLMDHVGTEPSIKEDQVIQLMNAIFSKKNFESLS         250  251

EAFSVASAAAVLSHNRYHVPVVVVPEGSASDTHEQAILRLQVTNVLSQPL         300
||||||||||||||||||||||||||||||||||||||||||||||||||         251
EAFSVASAAAVLSHNRYHVPVVVVPEGSASDTHEQAILRLQVTNVLSQPL         300  301

TQATVKLEHAKSVASRATVLQKTSFTPVGDVFELNFMNVKFSSGYYDFLV         350
||||||||||||||||||||||||||||||||||||||||||||||||||         301
TQATVKLEHAKSVASRATVLQKTSFTPVGDVFELNFMNVKFSSGYYDFLV         350  351

EVEGDNRYIANTVELRVKISTEVGITNVDLSTVDKDQSIAPKTTRVTYPA         400
||||||||||||||||||||||||||||||||||||||||||||||||||         351
EVEGDNRYIANTVELRVKISTEVGITNVDLSTVDKDQSIAPKTTRVTYPA         400  401

KAKGTFIADSHQNFA                                           415
|||||||||||||||                                           401
KAKGTFIADSHQNFA                                           415
```

Sequence name: RIB2_HUMAN (SEQ ID NO:663)

Sequence documentation:

Alignment of: T46984_PEA.sub.--1_P32 (SEQ ID NO:671).times.RIB2_HUMAN (SEQ ID NO:663).

Alignment segment 1/1: TABLE-US-01131 Quality: 3434.00 Escore: 0 Matching length: 373 Total length: 373 Matching Percent 98.93 Matching Percent Identity: 98.39 Similarity: Total Percent Similarity: 98.93 Total Percent Identity: 98.39 Gaps: 0

```
Alignment TABLE-US-01132 1
MAPPGSSTVFLLALTIIASTWALTPTHYLTKHDVERLKASLDRPFTNLES          50
||||||||||||||||||||||||||||||||||||||||||||||||||          1
MAPPGSSTVFLLALTIIASTWALTPTHYLTKHDVERLKASLDRPFTNLES          50   51

AFYSIVGLSSLGAQVPDAKKACTYIRSNLDPSNVDSLFYAAQASQALSGC         100
||||||||||||||||||||||||||||||||||||||||||||||||||         51
AFYSIVGLSSLGAQVPDAKKACTYIRSNLDPSNVDSLFYAAQASQALSGC         100  101

EISISNETKDLLLAAVSEDSSVTQIYHAVAALSGFGLPLASQEALSALTA         150
||||||||||||||||||||||||||||||||||||||||||||||||||         101
EISISNETKDLLLAAVSEDSSVTQIYHAVAALSGFGLPLASQEALSALTA         150  151

RLSKEETVLATVQALQTASHLSQQADLRSIVEEIEDLVARLDELGGVYLQ         200
||||||||||||||||||||||||||||||||||||||||||||||||||         151
RLSKEETVLATVQALQTASHLSQQADLRSIVEEIEDLVARLDELGGVYLQ         200  201

FEEGLETTALFVAATYKLMDHVGTEPSIKEDQVIQLMNAIFSKKNFESLS         250
||||||||||||||||||||||||||||||||||||||||||||||||||         201
FEEGLETTALFVAATYKLMDHVGTEPSIKEDQVIQLMNAIFSKKNFESLS         250  251

EAFSVASAAAVLSHNRYHVPVVVVPEGSASDTHEQAILRLQVTNVLSQPL         300
||||||||||||||||||||||||||||||||||||||||||||||||||         251
EAFSVASAAAVLSHNRYHVPVVVVPEGSASDTHEQAILRLQVTNVLSQPL         300  301

TQATVKLEHAKSVASRATVLQKTSFTPVGDVFELNFMNVKFSSGYYDFLV         350
||||||||||||||||||||||||||||||||||||||||||||||||||         301
TQATVKLEHAKSVASRATVLQKTSFTPVGDVFELNFMNVKFSSGYYDFLV         350  351

EVEGDNRYIANTVEGQVRWLTPV                                   373
|||||||||||||  :|: | |
EVEGDNRYIANTVELRVKISTEV                                   373
```

Sequence name: RIB2_HUMAN (SEQ ID NO:663)

Sequence documentation:

Alignment of: T46984_PEA.sub.--1_P34 (SEQ ID NO:672).times.RIB2_HUMAN (SEQ ID NO:663).

Alignment segment 1/1: TABLE-US-01133 Quality: 3087.00 Escore: 0 Matching length: 329 Total length: 329 Matching Percent 100.00 Matching Percent Identity: 100.00 Similarity: Total Percent Similarity: 100.00 Total Percent Identity: 100.00 Gaps: 0

```
Alignment: TABLE-US-01134 1
MAPPGSSTVFLLALTIIASTWALTPTHYLTKHDVERLKASLDRPFTNLES   50
||||||||||||||||||||||||||||||||||||||||||||||||||   1
MAPPGSSTVFLLALTIIASTWALTPTHYLTKHDVERLKASLDRPFTNLES   50  51

AFYSIVGLSSLGAQVPDAKKACTYIRSNLDPSNVDSLFYAAQASQALSGC   100
||||||||||||||||||||||||||||||||||||||||||||||||||   51
AFYSIVGLSSLGAQVPDAKKACTYIRSNLDPSNVDSLFYAAQASQALSGC   100  101

EISISNETKDLLLAAVSEDSSVTQTYHAVAALSGFGLPLASQEALSALTA   150
||||||||||||||||||||||||||||||||||||||||||||||||||   101
EISISNETKDLLLAAVSEDSSVTQTYHAVAALSGFGLPLASQEALSALTA   150  151

RLSKEETVLATVQALQTASHLSQQADLRSIVEEIEDLVARLDELGGVYLQ   200
||||||||||||||||||||||||||||||||||||||||||||||||||   151
RLSKEETVLATVQALQTASHLSQQADLRSIVEEIEDLVARLDELGGVYLQ   200  201

FEEGLETTALFVAATYKLMDHVGTEPSIKEDQVIQLMNAIFSKKNFESLS   250
||||||||||||||||||||||||||||||||||||||||||||||||||   201
FEEGLETTALFVAATYKLMDHVGTEPSIKEDQVIQLMNAIFSKKNFESLS   250  251

EAFSVASAAAVLSHNRYHVPVVVVPEGSASDTHEQAILRLQVTNVLSQPL   300
||||||||||||||||||||||||||||||||||||||||||||||||||   251
EAFSVASAAAVLSHNRYHVPVVVVPEGSASDTHEQAILRLQVTNVLSQPL   300  301

TQATVKLEHAKSVASRATVLQKTSFTPVG   329
|||||||||||||||||||||||||||||   301
TQATVKLEHAKSVASRATVLQKTSFTPVG   329
```

Sequence name: RIB2_HUMAN (SEQ ID NO:663)

Sequence documentation:

Alignment of: T46984_PEA.sub.--1_P35 (SEQ ID NO:673).times.RIB2_HUMAN (SEQ ID NO:663).

Alignment segment 1/1: TABLE-US-01135 Quality: 2697.00 Escore: 0 Matching length: 287 Total length: 287 Matching Percent 100.00 Matching Percent Identity: 100.00 Similarity: Total Percent Similarity: 100.00 Total Percent Identity: 100.00 Gaps: 0

```
Alignment TABLE-US-01136 1
MAPPGSSTVFLLALTIIASTWALTPTHYLTKHDVERLKASLDRPFTNLES   50
||||||||||||||||||||||||||||||||||||||||||||||||||   1
MAPPGSSTVFLLALTIIASTWALTPTHYLTKHDVERLKASLDRPFTNLES   50  51

AFYSIVGLSSLGAQVPDAKKACTYIRSNLDPSNVDSLFYAAQASQALSGC   100
||||||||||||||||||||||||||||||||||||||||||||||||||   51
AFYSIVGLSSLGAQVPDAKKACTYIRSNLDPSNVDSLFYAAQASQALSGC   100  101

EISISNETKDLLLAAVSEDSSVTQIYHAVAALSGFGLPLASQEALSALTA   150
||||||||||||||||||||||||||||||||||||||||||||||||||   101
EISISNETKDLLLAAVSEDSSVTQIYHAVAALSGFGLPLASQEALSALTA   150  151

RLSKEETVLATVQALQTASHLSQQADLRSIVEEIEDLVARLDELGGVYLQ   200
||||||||||||||||||||||||||||||||||||||||||||||||||   151
RLSKEETVLATVQALQTASHLSQQADLRSIVEEIEDLVARLDELGGVYLQ   200  201

FEEGLETTALFVAATYKLMDHVGTEPSIKEDQVIQLMNAIFSKKNFESLS   250
||||||||||||||||||||||||||||||||||||||||||||||||||   201
FEEGLETTALFVAATYKLMDHVGTEPSIKEDQVIQLMNAIFSKKNFESLS   250  251

EAFSVASAAAVLSHNRYHVPVVVVPEGSASDTHEQAI   287
||||||||||||||||||||||||||||||||||||   251
EAFSVASAAAVLSHNRYHVPVVVVPEGSASDTHEQAI   287
```

Sequence name: RIB2_HUMAN (SEQ ID NO:663)

Sequence documentation:

Alignment of: T46984_PEA.sub.--1_P38 (SEQ ID NO:674).times.RIB2_HUMAN (SEQ ID NO:663).

Alignment segment 1/1: TABLE-US-01137 Quality: 1368.00 Escore: 0 Matching length: 145 Total length: 145 Matching Percent 100.00 Matching Percent Identity: 100.00 Similarity: Total Percent Similarity: 100.00 Total Percent Identity: 100.00 Gaps: 0

```
Alignment: TABLE-US-01138 1
MAPPGSSTVFLLALTIIASTWALTPTHYLTKHDVERLKASLDRPFTNLES    50
|||||||||||||||||||||||||||||||||||||||||||||||||    1
MAPPGSSTVFLLALTIIASTWALTPTHYLTKHDVERLKASLDRPFTNLES    50 51

AFYSIVGLSSLGAQVPDAKKACTYIRSNLDPSNVDSLFYAAQASQALSGC    100
|||||||||||||||||||||||||||||||||||||||||||||||||    51
AFYSIVGLSSLGAQVPDAKKACTYIRSNLDPSNVDSLFYAAQASQALSGC    100 101

EISISNETKDLLLAAVSEDSSVTQIYHAVAALSGFGLPLASQEAL    145
||||||||||||||||||||||||||||||||||||||||||||    101
EISISNETKDLLLAAVSEDSSVTQIYHAVAALSGFGLPLASQEAL    145
```

Sequence name: RIB2_HUMAN (SEQ ID NO:663)

Sequence documentation:

Alignment of: T46984_PEA.sub.--1_P39 (SEQ ID NO:675).times.RIB2_HUMAN (SEQ ID NO:663).

Alignment segment 1/1: TABLE-US-01139 Quality: 1500.00 Escore: 0 Matching length: 160 Total length: 160 Matching Percent 100.00 Matching Percent Identity: 100.00 Similarity: Total Percent Similarity: 100.00 Total Percent Identity: 100.00 Gaps: 0

```
Alignment TABLE-US-01140 1
MAPPGSSTVFLLALTIIASTWALTPTHYLTKHDVERLKASLDRPFTNLES    50
|||||||||||||||||||||||||||||||||||||||||||||||||    1
MAPPGSSTVFLLALTIIASTWALTPTHYLTKHDVERLKASLDRPFTNLES    50 51

AFYSIVGLSSLGAQVPDAKKACTYIRSNLDPSNVDSLFYAAQASQALSGC    100
|||||||||||||||||||||||||||||||||||||||||||||||||    51
AFYSIVGLSSLGAQVPDAKKACTYIRSNLDPSNVDSLFYAAQASQALSGC    100 101

EISISNETKDLLLAAVSEDSSVTQIYHAVAALSGFGLPLASQEALSALTA    150
|||||||||||||||||||||||||||||||||||||||||||||||||    101
EISISNETKDLLLAAVSEDSSVTQIYHAVAALSGFGLPLASQEALSALTA    150 151

RLSKEETVLA    160
||||||||||    151
RLSKEETVLA    160
```

Sequence name: RIB2_HUMAN (SEQ ID NO:663)

Sequence documentation:

Alignment of: T46984_PEA.sub.--1_P45 (SEQ ID NO:676).times.RIB2_HUMAN (SEQ ID NO:663)

Alignment segment 1/1: TABLE-US-01141 Quality: 970.00 Escore: 0 Matching length: 103 Total length: 103 Matching Percent 99.03 Matching Percent Identity: 99.03 Similarity: Total Percent Similarity: 99.03 Total Percent Identity: 99.03 Gaps: 0

```
Alignment TABLE-US-01142 1
MAPPGSSTVFLLALTIIASTWALTPTHYLTKHDVERLKASLDRPFTNLES    50
|||||||||||||||||||||||||||||||||||||||||||||||||    1
MAPPGSSTVFLLALTIIASTWALTPTHYLTKHDVERLKASLDRPFTNLES    50 51

AFYSIVGLSSLGAQVPDAKKACTYIRSNLDPSNVDSLFYAAQASQALSGC    100
|||||||||||||||||||||||||||||||||||||||||||||||||    51
AFYSIVGLSSLGAQVPDAKKACTYIRSNLDPSNVDSLFYAAQASQALSGC    100 101

ENS    103
|||    101
EIS    103
```

Sequence name: RIB2_HUMAN (SEQ ID NO:663)
Sequence documentation:
Alignment of: T46984_PEA.sub.--1_P46 (SEQ ID NO:677).times.RIB2_HUMAN (SEQ ID NO:663).
Alignment segment 1/1: TABLE-US-01143 Quality: 656.00 Escore: 0 Matching length: 69 Total length: 69 Matching Percent 100.00 Matching Percent Identity: 100.00 Similarity: Total Percent Similarity: 100.00 Total Percent Identity: 100.00 Gaps: 0

```
Alignment TABLE-US-01144 1
MAPPGSSTVFLLALTIIASTWALTPTHYLTKHDVERLKASLDRPFTNLES       50
|||||||||||||||||||||||||||||||||||||||||||||||||        1
MAPPGSSTVFLLALTIIASTWALTPTHYLTKHDVERLKASLDRPFTNLES       50 51

AFYSIVGLSSLGAQVPDAK                                      69
|||||||||||||||||||                                      51
AFYSIVGLSSLGAQVPDAK                                      69
```

Description for Cluster T11628

Cluster T11628 features 6 transcript(s) and 25 segment(s) of interest, the names for which are given in Tables 1 and 2, respectively, the sequences themselves are given at the end of the application. The selected protein variants are given in table 3. TABLE-US-01145 TABLE 1 Transcripts of interest Transcript Name Sequence ID No. T11628_PEA_1_T3 678 T11628_PEA_1_T4 679 T11628_PEA_1_T5 680 T11628_PEA_1_T7 681 T11628_PEA_1_T9 682 T11628_PEA_1_T11 683

TABLE-US-01146 TABLE 2 Segments of interest Segment Name Sequence ID No. T11628_PEA_1_node_7 684 T11628_PEA_1_node_11 685 T11628_PEA_1_node_16 686 T11628_PEA_1_node_22 687 T11628_PEA_1_node_25 688 T11628_PEA_1_node_31 689 T11628_PEA_1_node_37 690 T11628_PEA_1_node_0 691 T11628_PEA_1_node_4 692 T11628_PEA_1_node_9 693 T11628_PEA_1_node_13 694 T11628_PEA_1_node_14 692 T11628_PEA_1_node_17 696 T11628_PEA_1_node_18 697 T11628_PEA_1_node_19 698 T11628_PEA_1_node_24 699 T11628_PEA_1_node_27 700 T11628_PEA_1_node_28 701 T11628_PEA_1_node_29 702 T11628_PEA_1_node_30 703 T11628_PEA_1_node_32 704 T11628_PEA_1_node_33 705 T11628_PEA_1_node_34 706 T11628_PEA_1_node_35 707 T11628_PEA_1_node_36 708

TABLE-US-01147 TABLE 3 Proteins of interest Sequence Protein Name ID No. Corresponding Transcript(s) T11628_PEA_1_P2 712 T11628_PEA_1_T3 (SEQ ID NO: 678); T11628_PEA_1_T5 (SEQ ID NO: 680); T11628_PEA_1_T7 (SEQ ID NO: 681) T11628_PEA_1_P5 713 T11628_PEA_1_T9 (SEQ ID NO: 682) T11628_PEA_1_P7 714 T11628_PEA_1_T11 (SEQ ID NO: 683) T11628_PEA_1_P10 715 T11628_PEA_1_T4 (SEQ ID NO: 679)

These sequences are variants of the known protein Myoglobin (SwissProt accession identifier MYG_HUMAN), SEQ ID NO: 709, referred to herein as the previously known protein.

Protein Myoglobin (SEQ ID NO:709) is known or believed to have the following function(s): Serves as a reserve supply of oxygen and facilitates the movement of oxygen within muscles. The sequence for protein Myoglobin (SEQ ID NO:709) is given at the end of the application, as "Myoglobin (SEQ ID NO:709) amino acid sequence". Known polymorphisms for this sequence are as shown in Table 4. TABLE-US-01148 TABLE 4 Amino acid mutations for Known Protein SNP position(s) on amino acid sequence Comment 54 E→K./FTId=VAR_003180. 133 K→N./FTId=VAR_003181. 139 R→Q./FTId=VAR_003182. 139 R→W./FTId=VAR_003183. 128 Q→E As noted above, cluster T11628 features 6 transcript(s), which were listed in Table 1 above. These transcript(s) encode for protein(s) which are variant(s) of protein Myoglobin (SEQ ID NO:709). A description of each variant protein according to the present invention is now provided.

Variant protein T11628_PEA.sub.--1_P2 (SEQ ID NO:712) according to the present invention has an amino acid sequence as given at the end of the application; it is encoded by transcript(s) T11628_PEA.sub.--1_T3 (SEQ ID NO:678). An alignment is given to the known protein (Myoglobin (SEQ ID NO:709)) at the end of the application. One or more alignments to one or more previously published protein sequences are given at the end of the application. A brief description of the relationship of the variant protein according to the present invention to each such aligned protein is as follows:

Comparison report between T11628_PEA.sub.--1_P2 (SEQ ID NO:712) and Q8WVH6 (SEQ ID NO:711) (SEQ ID NO:711):

1. An isolated chimeric polypeptide encoding for T11628_PEA.sub.--1.sub.--P2 (SEQ ID NO:712), comprising a first amino acid sequence being at least 70%, optionally at least 80%, preferably at least 85%, more preferably at least 90% and most preferably at least 95% homologous to a polypeptide having the sequence MGLSDGEWQLVLN-VWGKVEADIPGHGQEVLIRLFKGH-PETLEKFDKFKHLKSEDE (SEQ ID NO:956) corresponding to amino acids 1-55 of T11628_PEA.sub.--1_P2 (SEQ ID NO:712), and a second amino acid sequence being at least 90% homologous to MKASEDLKKHGATVLTALG-GILKKKGHHEAEIKPLAQSHATKH-KIPVKYLEFISECIIQV LQSKHPGDFGADAQ-GAMNKALELFRKDMASNYKELGFQG corresponding to amino acids 1-99 of Q8WVH6 (SEQ ID NO:711), which also corresponds to amino acids 56-154 of T11628_PEA.sub.--1_P2 (SEQ ID NO:712), wherein said first amino acid sequence and second amino acid sequence are contiguous and in a sequential order.

2. An isolated polypeptide encoding for a head of T11628_PEA.sub.--1_P2 (SEQ ID NO:712), comprising a polypeptide being at least 70%, optionally at least about 80%, preferably at least about 85%, more preferably at least about 90% and most preferably at least about 95% homologous to the sequence TABLE-US-01149 MGLSDGEWQLVLN-VWGKVEADIPGHGQEVLIRLFKGH-PETLEKFDKFKHLKSEDE (SEQ ID NO:956) of T11628_PEA_1_P2. (SEQ ID NO:712)

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T11628_PEA.sub.--1_P2 (SEQ ID NO:712) also has the following non-silent SNPs(Single Nucleotide Polymorphisms) as listed in Table 5, (given according to their position(s) on the amino acid sequence, with the alternative amino acid(s) listed; the last column indicates whether the SNP is known or not; the presence of known SNPs in variant protein T11628_PEA.sub.--1_P2 (SEQ ID NO:712) sequence provides support for the deduced sequence of this variant protein according to the present invention). TABLE-US-011 50 TABLE 5 Amino acid mutations SNP position(s) on amino acid Alternative sequence amino acid(s) Previously known SNP? 26 G→No 44 F→No 92 Q→R No 135 A→No 141 K→No 153 Q→No Variant protein T11628_PEA.sub.--1_P2 (SEQ ID NO:712) is encoded by the following transcript(s): T11628_PEA.sub.--1_T3 (SEQ ID NO:678), for which the sequence(s) is/are given at the end of the application. The coding portion of transcript T11628_PEA.sub.--1_T3 (SEQ ID NO:678) is shown in bold; this coding portion starts at position 220 and ends at position 681. The transcript also has the following SNPs as listed in Table 6 (given according to their position on the nucleotide sequence, with the alternative nucleic acid listed; the last column indicates whether the SNP is known or not; the presence of known SNPs in variant protein T11628_PEA.sub.--1_P2 (SEQ ID NO:712) sequence provides support for the deduced sequence of this variant protein according to the present invention). TABLE-US-011 51 TABLE 6 Nucleic acid SNPs SNP position on nucleotide Alternative sequence nucleic acid Previously known SNP? 83 G→A Yes 93 G→A Yes 95 G→A Yes 146 G→A Yes 295 G→No 349 T→No 393 G→A Yes 423 C→T Yes 494 A→G No 498 G→A No 623 C→No 642 G→No 678 G→No 686 C→No 686 C→A No 717 C→No 787 T→G No 820 G→T No 826 G→T No 850 C→No 934 T→G No 975 A→G Yes 1117 G→No 1218 A→G No Variant protein T11628_PEA.sub.--1_P5 (SEQ ID NO:713) according to the present invention has an amino acid sequence as given at the end of the application; it is encoded by transcript(s) T11628_PEA.sub.--1_T9 (SEQ ID NO:682). An alignment is given to the known protein (Myoglobin (SEQ ID NO:709) ) at the end of the application. One or more alignments to one or more previously published protein sequences are given at the end of the application. A brief description of the relationship of the variant protein according to the present invention to each such aligned protein is as follows:

Comparison report between T11628_PEA.sub.--1_P5 (SEQ ID NO:713) and MYG_HUMAN.sub.--V1 (SEQ ID NO:710):

1. An isolated chimeric polypeptide encoding for T11628_PEA.sub.--1_P5 (SEQ ID NO:713), comprising a first amino acid sequence being at least 90% homologous to MKASEDLKKHGATVLTALGGILKKKGH-HEAEIKPLAQSHATKHKIPVKYLEFISECIIQV LQSKH-PGDFGADAQGAMNKALELFRKDMASNYKELGFQG corresponding to amino acids 56-154 of MYG_HUMAN_V1 (SEQ ID NO:710), which also corresponds to amino acids 1-99 of T11628_PEA.sub.--1_P5 (SEQ ID NO:713).

It should be noted that the known protein sequence (MYG_HUMAN (SEQ ID NO:709)) has one or more changes than the sequence given at the end of the application and named as being the amino acid sequence for MYG_HUMAN_V1 (SEQ ID NO: 710). These changes were previously known to occur and are listed in the table below. TABLE-US-011 52 TABLE 7 Changes to MYG_HUMAN_V1 (SEQ ID NO: 710) SNP position(s) on amino acid sequence Type of change 1 init_met The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T11628_PEA.sub.--1_P5 (SEQ ID NO:713) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein T11628_PEA.sub.--1_P5 (SEQ ID NO:713) sequence provides support for the deduced sequence of this variant protein according to the present invention). TABLE-US-011 53 TABLE 8 Amino acid mutations SNP position(s) on amino acid Alternative sequence amino acid(s) Previously known SNP? 37 Q→R No 80 A→No 86 K→No 98 Q→No Variant protein T11628_PEA.sub.--1_P5 (SEQ ID NO:713) is encoded by the following Transcript(s): T11628_PEA.sub.--1_T9 (SEQ ID NO:682), for which the sequence(s) is/are given at the end of the application. The coding portion of transcript T11628_PEA.sub.--1_T9 (SEQ ID NO:682) is shown in bold; this coding portion starts at position 211 and ends at position 507. The transcript also has the following SNPs as listed in Table 9 (given according to their position on the nucleotide sequence, with the alternative nucleic acid listed; the last column indicates whether the SNP is known or not; the presence of known SNPs in variant protein T11628_PEA.sub.--1_P5 (SEQ ID NO:713) sequence provides support for the deduced sequence of this variant protein according to the present invention). TABLE-US-011 54 TABLE 9 Nucleic acid SNPs SNP position on nucleotide sequence Alternative nucleic acid Previously known SNP? 2 C→T Yes 175 T→No 219 G→A Yes 249 C→T Yes 320 A→G No 324 G→A No 449 C→No 468 G→No 504 G→No 512 C→No 512 C→A No 543 C→No 613 T→G No 646 G→T No 652 G→T No 676 C→No 760 T→G No 801 A→G Yes 943 G→No 1044 A→G No Variant protein T11628_PEA.sub.--1_P7 (SEQ ID NO:714) according to the present invention has an amino acid sequence as given at the end of the application; it is encoded by transcript(s) T11628_PEA.sub.--1_T11 (SEQ ID NO:683). An alignment is given to the known protein (Myoglobin (SEQ ID NO:709)) at the end of the application. One or more alignments to one or more previously published protein sequences are given at the end of the application. A brief description of the relationship of the variant protein according to the present invention to each such aligned protein is as follows:

Comparison report between T11628_PEA.sub.--1_P7 (SEQ ID NO:714) and MYG_HUMAN_V1 (SEQ ID NO:710):

1. An isolated chimeric polypeptide encoding for T11628_PEA.sub.--1_P7 (SEQ ID NO:714), comprising a first amino acid sequence being at least 90% homologous to MGLSDGEWQLVLNVWGKVEADIPGH-GQEVLIRLFKGHPETLEKFDKFKHLKSEDEMK ASEDLKKHGATVLTALGGILKKKGHHE-AEIKPLAQSHATKHKIPVKYLEFISECIIQVLQ SKH-PGDFGADAQGAMNK corresponding to amino acids 1-134 of MYG_HUMAN_V1, which also corresponds to amino acids 1-134 of T11628_PEA.sub.--1_P7 (SEQ ID NO:714), and a second amino acid sequence being at least 70%, optionally at least 80%, preferably at least 85%, more preferably at least 90% and most preferably at least 95% homologous to a polypeptide having the sequence G corresponding to amino acids 135-135 of T11628_PEA.sub.--1_P7 (SEQ ID NO:714), wherein said first amino acid sequence and second amino acid sequence are contiguous and in a sequential order.

It should be noted that the known protein sequence (MYG_HUMAN (SEQ ID NO:709)) has one or more changes than the sequence given at the end of the application and named as being the amino acid sequence for MYG_HUMAN_V1 (SEQ ID NO:710). These changes were previously known to occur and are listed in the table below. TABLE-US-01155 TABLE 10 Changes to MYG_HUMAN_V1 (SEQ ID NO: 710) SNP position(s) on amino acid sequence Type of change 1 init_met The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T11628_PEA.sub.--1_P7 (SEQ ID NO:714) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein T11628_PEA.sub.--1_P7 (SEQ ID NO:714) sequence provides support for the deduced sequence of this variant protein according to the present invention). TABLE-US-01156 TABLE 11 Amino acid mutations SNP position(s) on amino acid Alternative sequence amino acid(s) Previously known SNP? 26 G→No 44 F→No 92 Q→R No Variant protein T11628_PEA.sub.--1_P7 (SEQ ID NO:714) is encoded by the following transcript(s): T11628_PEA.sub.--1_T11 (SEQ ID NO:683), for which the sequence(s) is/are given at the end of the application. The coding portion of transcript T11628_PEA.sub.--1_T11 (SEQ ID NO:683) is shown in bold; this coding portion starts at position 319 and ends at position 723. The transcript also has the following SNPs as listed in Table 12 (given according to their position on the nucleotide sequence, with the alternative nucleic acid listed; the last column indicates whether the SNP is known or not; the presence of known SNPs in variant protein T11628_PEA.sub.--1_P7 (SEQ ID NO:714) sequence provides support for the deduced sequence of this variant protein according to the present invention). TABLE-US-01157 TABLE 12 Nucleic acid SNPs SNP position on nucleotide sequence Alternative nucleic acid Previously known SNP? 394 G→No 448 T→No 492 G→A Yes 522 C→T Yes 593 A→G No 597 G→A No 728 C→No 728 C→A No 759 C→No 829 T→G No 862 G→T No 868 G→T No 892 C→No 976 T→G No 1017 A→G Yes 1159 G→No 1260 A→G No Variant protein T11628_PEA.sub.--1_P10 (SEQ ID NO:715) according to the present invention has an amino acid sequence as given at the end of the application; it is encoded by transcript(s) T11628_PEA.sub.--1_T4 (SEQ ID NO:679). An alignment is given to the known protein (Myoglobin (SEQ ID NO:709)) at the end of the application. One or more alignments to one or more previously published protein sequences are given at the end of the application. A brief description of the relationship of the variant protein according to the present invention to each such aligned protein is as follows:

Comparison report between T11628_PEA.sub.--1_P10 (SEQ ID NO:715) and Q8WVH6 (SEQ ID NO:711):

1. An isolated chimeric polypeptide encoding for T11628_PEA.sub.--1_P10 (SEQ ID NO:715), comprising a first amino acid sequence being at least 70%, optionally at least 80%, preferably at least 85%, more preferably at least 90% and most preferably at least 95% homologous to a polypeptide having the sequence MGLSDGEWQLVLN-VWGKVEADIPGHGQEVLIRLFKGH-PETLEKFDKFKHLKSEDE (SEQ ID NO:956) corresponding to amino acids 1-55 of T11628_PEA.sub.--1_P10 (SEQ ID NO:715), and a second amino acid sequence being at least 90% homologous to MKASEDLKKHGATVLTALG-GILKKKGHHEAEIKPLAQSHATKH-KIPVKYLEFISECIIQV LQSKHPGDFGADAQ-GAMNKALELFRKDMASNYKELGFQG corresponding to amino acids 1-99 of Q8WVH6 (SEQ ID NO:711), which also corresponds to amino acids 56-154 of T11628_PEA.sub.--1_P10 (SEQ ID NO:715), wherein said first amino acid sequence and second amino acid sequence are contiguous and in a sequential order.

2. An isolated polypeptide encoding for a head of T11628_PEA.sub.--1_P10 (SEQ ID NO:715), comprising a polypeptide being at least 70%, optionally at least about 80%, preferably at least about 85%, more preferably at least about 90% and most preferably at least about 95% homologous to the sequence TABLE-US-01158 MGLSDGEWQLVLN-VWGKVEADIPGHGQEVLIRLFKGH-PETLEKFDKFKHLKSEDE (SEQ ID NO:956) of T11628_PEA__1_P10. (SEQ ID NO:715)

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T11628_PEA.sub.--1_P10 (SEQ ID NO:715) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein T11628_PEA.sub.--1_P10 (SEQ ID NO:715) sequence provides support for the deduced sequence of this variant protein according to the present invention). TABLE-US-01159 TABLE 13 Amino acid mutations SNP position(s) on amino acid Alternative sequence amino acid(s) Previously known SNP? 26 G→No 44 F→No 92 Q→R No 135 A→No 141 K→No 153 Q→No Variant protein T11628_PEA.sub.--1_P10 (SEQ ID NO:715) is encoded by the following transcript(s): T11628_PEA.sub.--1_T4 (SEQ ID NO:679), for which the sequence(s) is/are given at the end of the application. The coding portion of transcript T11628_PEA.sub.--1_T4 (SEQ ID NO:679) is shown in bold; this coding portion starts at position 205 and ends at position 666. The transcript also has the following SNPs as listed in Table 14 (given according to their position on the nucleotide sequence, with the alternative nucleic acid listed; the last column indicates whether the SNP is known or not; the presence of known SNPs in variant protein T11628_PEA.sub.--1_P10 (SEQ ID NO:715) sequence provides support for the deduced sequence of this variant protein according to the present invention). TABLE-US-01160 TABLE 14 Nucleic acid SNPs SNP position on nucleotide sequence Alternative nucleic acid Previously known SNP? 280 G→No 334 T→No 378 G→A Yes 408 C→T Yes 479 A→G No 483 G→A No 608 C→No 627 G→No 663 G→No 671 C→No 671 C→A No 702 C→No 772 T→G No 805 G→T No 811 G→T No835 C→No919 T→G No 960 A→G Yes 1102 G→No 1203 A→G No As noted above, cluster T11628 features 25 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T11628_PEA.sub.--1_node.sub.--7 (SEQ ID NO:684) according to the present invention is supported by 9 libraries. The number of libraries was determined as previously described. This segment can be found in the following transcript(s): T11628_PEA.sub.--1_T3 (SEQ ID NO:678). Table 15 below describes the starting and ending position of this segment on each transcript. TABLE-US-01161 TABLE 15 Segment location on transcripts Segment Segment Transcript name starting position ending position T11628_PEA__1_T3 (SEQ ID NO: 1 211 678)

Segment clusterT11628_PEA.sub.--1_node.sub.--11 (SEQ ID NO:685) according to the present invention is supported by 1 libraries. The number of libraries was determined as previously described. This segment can be found in the following transcript(s): T11628_PEA.sub.--1_T5 (SEQ ID NO:680). Table 16 below describes the starting and ending position of this segment on each transcript. TABLE-US-01162 TABLE 16 Segment location on transcripts Segment Segment Transcript name starting position ending position T11628_PEA__1_T5 (SEQ ID NO: 48 178 680)

Segment cluster T11628_PEA.sub.--1_node.sub.--16 (SEQ ID NO:686) according to the present invention is supported by 38 libraries. The number of libraries was determined as previously described. This segment can be found in the following transcript(s): T11628_PEA.sub.--1_T11 (SEQ ID NO:683). Table 17 below describes the starting and ending position of this segment on each transcript. TABLE-US-01163 TABLE 17 Segment location on transcripts Segment Segment Transcript name starting position ending position T11628_PEA__1_T11 (SEQ ID 1 214 NO: 683)

Segment cluster T11628_PEA.sub.--1_node.sub.--22 (SEQ ID NO:687) according to the present invention is supported by 1 libraries. The number of libraries was determined as previously described. This segment can be found in the following transcript(s): T11628_PEA.sub.--1_T9 (SEQ ID NO:682). Table 18 below describes the starting and ending position of this segment on each transcript. TABLE-US-01164 TABLE 18 Segment location on transcripts Segment Segment Transcript name starting position ending position T11628_PEA__1_T9 (SEQ ID NO: 1 140 682)

Segment cluster T11628_PEA.sub.--1_node.sub.--25 (SEQ ID NO:688) according to the present invention is supported by 129 libraries. The number of libraries was determined as previously described. This segment can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681), T11628_PEA.sub.--1_T9 (SEQ ID NO:682) and T11628_PEA.sub.--1_T11 (SEQ ID NO:683). Table 19 below describes the starting and ending position of this segment on each transcript. TABLE-US-01165 TABLE 19 Segment location on transcripts Segment Segment ending Transcript name starting position position T11628_PEA__1_T3 (SEQ ID NO: 678) 395 537 T11628_PEA__1_T4 (SEQ ID NO: 679) 380 522 T11628_PEA__1_T5 (SEQ ID NO: 680) 362 504 T11628_PEA__1_T7 (SEQ ID NO: 681) 347 489 T11628_PEA__1_T9 (SEQ ID NO: 682) 221 363 T11628_PEA__1_T11 (SEQ ID 494 636 NO: 683)

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to breast cancer), shown in Table 20. TABLE-US-01166 TABLE 20 Oligonucleotides related to this segment Oligonucleotide name Overexpressed in cancers Chip reference T11628__0__9__0 (SEQ ID breast malignant tumors BRS NO: 911)

Segment cluster T11628_PEA.sub.--1_node.sub.--31 (SEQ ID NO:689) according to the present invention is supported by 137 libraries. The number of libraries was determined as previously described. This segment can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681), T11628_PEA.sub.--1_T9 (SEQ ID NO:682) and T11628_PEA.sub.--1_T11 (SEQ ID NO:683). Table 21 below describes the starting and ending position of this segment on each transcript. TABLE-US-01167 TABLE 21 Segment location on transcripts Segment Segment ending Transcript name starting position position T11628_PEA__1_T3 (SEQ ID NO: 678) 702 831 T11628_PEA__1_T4 (SEQ ID NO: 679) 687 816 T11628_PEA__1_T5 (SEQ ID NO: 680) 669 798 T11628_PEA__1_T7 (SEQ ID NO: 681) 654 783 T11628_PEA__1_T9 (SEQ ID NO: 682) 528 657 T11628_PEA__1_T11 (SEQ ID 744 873 NO: 683)

Segment cluster T11628_PEA.sub.--1_node.sub.--37 (SEQ ID NO:690) according to the present invention is supported by 99 libraries. The number of libraries was determined as previously described. This segment can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681), T11628_PEA.sub.--1_T9 (SEQ ID NO:682) and T11628_PEA.sub.--1_T11 (SEQ ID NO:683). Table 22 below describes the starting and ending position of this segment on each transcript. TABLE-US-01168 TABLE 22 Segment location on transcripts Segment Segment ending Transcript name starting position position T11628_PEA__1_T3 (SEQ ID NO: 678) 1086 1225 T11628_PEA__1_T4 (SEQ ID NO: 679) 1071 1210 T11628_PEA__1_T5 (SEQ ID NO: 680) 1053 1192 T11628_PEA__1_T7 (SEQ ID NO: 681)1038

1177 T11628_PEA__1_T9 (SEQ ID NO: 682) 912 1051 T11628_PEA__1_T11 (SEQ ID 1128 1267 NO: 683)

According to an optional embodiment of the present invention, short segments related to the above cluster are also provided. These segments are up to about 120 bp in length, and so are included in a separate description.

Segment cluster T11628_PEA.sub.--1_node.sub.--0 (SEQ ID NO:691) according to the present invention is supported by 1 libraries. The number of libraries was determined as previously described. This segment can be found in the following transcript(s): T11628_PEA.sub.--1_T4 (SEQ ID NO:679). Table 23 below describes the starting and ending position of this segment on each transcript. TABLE-US-01169 TABLE 23 Segment location on transcripts Segment Segment ending Transcript name starting position position T11628_PEA__1_T4 (SEQ ID NO: 679) 1 93

Segment cluster T11628_PEA.sub.--1_node.sub.--4 (SEQ ID NO:692) according to the present invention is supported by 2 libraries. The number of libraries was determined as previously described. This segment can be found in the following transcript(s): T11628_PEA.sub.--1_T4 (SEQ ID NO:679). Table 24 below describes the starting and ending position of this segment on each transcript. TABLE-US-01170 TABLE 24 Segment location on transcripts Segment Segment ending Transcript name starting position position T11628_PEA__1_T4 (SEQ ID NO: 679) 94 196

Segment cluster T11628_PEA.sub.--1_node.sub.--9 (SEQ ID NO:693) according to the present invention is supported by 16 libraries. The number of libraries was determined as previously described. This segment can be found in the following transcript(s): T11628_PEA.sub.--1_T5 (SEQ ID NO:680) and T11628_PEA.sub.--1_T7 (SEQ ID NO:681). Table 25 below describes the starting and ending position of this segment on each transcript. TABLE-US-01171 TABLE 25 Segment location on transcripts Segment Segment ending Transcript name starting position position T11628_PEA__1_T5 (SEQ ID NO: 680) 1 47 T11628_PEA__1_T7 (SEQ ID NO: 681) 1 47

Segment cluster T11628_PEA.sub.--1_node.sub.--13 (SEQ ID NO:694) according to the present invention can be found in the following transcript(s): T11628_PEA.sub.--1_T7 (SEQ ID NO:681). Table 26 below describes the starting and ending position of this segment on each transcript. TABLE-US-01172 TABLE 26 Segment location on transcripts Segment Segment ending Transcript name starting position position T11628_PEA__1_T7 (SEQ ID NO: 681) 48 65

Segment clusterT11628_PEA.sub.--1_node.sub.--14 (SEQ ID NO:695) according to the present invention is supported by 1 libraries. The number of libraries was determined as previously described. This segment can be found in the following transcript(s): T11628_PEA.sub.--1_T7 (SEQ ID NO:681). Table 27 below describes the starting and ending position of this segment on each transcript. TABLE-US-01173 TABLE 27 Segment location on transcripts Segment Segment ending Transcript name starting position position T11628_PEA__1_T7 (SEQ ID NO: 681) 66 163

Segment cluster T11628_PEA.sub.--1_node.sub.--17 (SEQ ID NO:696) according to the present invention is supported by 55 libraries. The number of libraries was determined as previously described. This segment can be found in the following transcript(s): T11628_PEA.sub.--1_T11 (SEQ ID NO:683). Table 28 below describes the starting and ending position of this segment on each transcript. TABLE-US-01174 TABLE 28 Segment location on transcripts Segment Segment Transcript name starting position ending position T11628_PEA__1_T11 (SEQ ID 215 310 NO: 683)

Segment cluster T11628_PEA.sub.--1_node.sub.--18 (SEQ ID NO:697) according to the present invention is supported by 98 libraries. The number of libraries was determined as previously described. This segment can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681) and T11628_PEA.sub.--1_T11 (SEQ ID NO:683). Table 29 below describes the starting and ending position of this segment on each transcript. TABLE-US-01175 TABLE 29 Segment location on transcripts Segment Segment ending Transcript name starting position position T11628_PEA__1_T3 (SEQ ID NO: 678) 212 289 T11628_PEA__1_T4 (SEQ ID NO: 679) 197 274 T11628_PEA__1_T5 (SEQ ID NO: 680) 179 256 T11628_PEA__1_T7 (SEQ ID NO: 681) 164 241 T11628_PEA__1_T11 (SEQ ID NO: 683) 311 388

Segment clusterT11628_PEA.sub.--1_node.sub.--19 (SEQ ID NO:698) according to the present invention can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681) and T11628_PEA.sub.--1_T11 (SEQ ID NO:683). Table 30 below describes the starting and ending position of this segment on each transcript. TABLE-US-01176 TABLE 30 Segment location on transcripts Segment Segment ending Transcript name starting position position T11628_PEA__1 _T3 (SEQ ID NO: 678) 290 314 T11628_PEA__1_T4 (SEQ ID NO: 679) 275 299 T11628_PEA__1_T5 (SEQ ID NO: 680) 257 281 T11628_PEA__1_T7 (SEQ ID NO: 681) 242 266 T11628_PEA__1_T11 (SEQ ID NO: 683) 389 413

Segment clusterT11628_PEA.sub.--1_node.sub.--24 (SEQ ID NO:699) according to the present invention is supported by 112 libraries. The number of libraries was determined as previously described. This segment can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681), T11628_PEA.sub.--1_T9 (SEQ ID NO:682) and T11628_PEA.sub.--1_T11 (SEQ ID NO:683). Table 31 below describes the starting and ending position of this segment on each transcript. TABLE-US-01177 TABLE 31 Segment location on transcripts Segment Segment ending Transcript name starting position position T11628_PEA__1_T3 (SEQ ID NO: 678) 315 394 T11628_PEA__1_T4 (SEQ ID NO: 679) 300 379 T11628_PEA__1_T5 (SEQ ID NO: 680) 282 361 T11628_PEA__1_T7 (SEQ ID NO: 681) 267 346 T11628_PEA__1_T9 (SEQ ID NO: 682) 141 220 T11628_PEA__1_T11 (SEQ ID 414 493 NO: 683)

Segment cluster T11628_PEA.sub.--1_node.sub.--27 (SEQ ID NO:700) according to the present invention is supported by 119 libraries. The number of libraries was determined as previously described. This segment can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681), T11628_PEA.sub.--1_T9 (SEQ ID NO:682) and T11628_PEA.sub.--1_T11 (SEQ ID NO:683). Table 32 below describes the starting and ending position of this segment on each transcript. TABLE-US-01178 TABLE 32 Segment location on transcripts Segment Segment ending Transcript name starting position position T11628_PEA__1_T3 (SEQ ID NO: 678) 538 621 T11628_PEA__1_T4 (SEQ ID NO: 679) 523 606 T11628_PEA__1_T5 (SEQ ID NO: 680)

505 588 T11628_PEA_1_T7 (SEQ ID NO: 681) 490 573 T11628_PEA_1_T9 (SEQ ID NO: 682) 364 447 T11628_PEA_1_T11 (SEQ ID 637 720 NO: 683)

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to breast cancer), shown in Table 33. TABLE-US-01179 TABLE 33 Oligonucleotides related to this segment Oligonucleotide name Overexpressed in cancers Chip reference T11628_0_9_0 (SEQ ID breast malignant tumors BRS NO: 911)

Segment cluster T11628_PEA.sub.--1_node.sub.--28 (SEQ ID NO:701) according to the present invention is supported by 115 libraries. The number of libraries was determined as previously described. This segment can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681) and T11628_PEA.sub.--1_T9 (SEQ ID NO:682). Table 34 below describes the starting and ending position of this segment on each transcript. TABLE-US-01180 TABLE 34 Segment location on transcripts Segment Segment ending Transcript name starting position position T11628_PEA_1_T3 (SEQ ID NO: 678) 622 650 T11628_PEA_1_T4 (SEQ ID NO: 679) 607 635 T11628_PEA_1_T5 (SEQ ID NO: 680) 589 617 T11628_PEA_1_T7 (SEQ ID NO: 681) 574 602 T11628_PEA_1_T9 (SEQ ID NO: 682) 448 476

Segment clusterT11628_PEA.sub.--1_node.sub.--29 (SEQ ID NO:702) according to the present invention is supported by 113 libraries. The number of libraries was determined as previously described. This segment can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681) and T11628_PEA.sub.--1_T9 (SEQ ID NO:682). Table 35 below describes the starting and ending position of this segment on each transcript. TABLE-US-01181 TABLE 35 Segment location on transcripts Segment Segment ending Transcript name starting position position T11628_PEA_1_T3 (SEQ ID NO: 678) 651 678 T11628_PEA_1_T4 (SEQ ID NO: 679) 636 663 T11628_PEA_1_T5 (SEQ ID NO: 680) 618 645 T11628_PEA_1_T7 (SEQ ID NO: 681) 603 630 T11628_PEA_1_T9 (SEQ ID NO: 682) 477 504

Segment cluster T11628_PEA.sub.--1_node.sub.--30 (SEQ ID NO:703) according to the present invention can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681), T11628_PEA.sub.--1_T9 (SEQ ID NO:682) and T11628_PEA.sub.--1_T11 (SEQ ID NO:683). Table 36 below describes the starting and ending position of this segment on each transcript. TABLE-US-01182 TABLE 36 Segment location on transcripts Segment Segment ending Transcript name starting position position T11628_PEA_1_T3 (SEQ ID NO: 678) 679 701 T11628_PEA_1_T4 (SEQ ID NO: 679) 664 686 T11628_PEA_1_T5 (SEQ ID NO: 680) 646 668 T11628_PEA_1_T7 (SEQ ID NO: 681) 631 653 T11628_PEA_1_T9 (SEQ ID NO: 682) 505 527 T11628_PEA_1_T11 (SEQ ID 721 743 NO: 683)

Segment cluster T11628_PEA.sub.--1_node.sub.--32 (SEQ ID NO:704) according to the present invention can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681), T11628_PEA.sub.--1_T9 (SEQ ID NO:682) and T11628_PEA.sub.--1_T11 (SEQ ID NO:683). Table 37 below describes the starting and ending position of this segment on each transcript. TABLE-US-01183 TABLE 37 Segment location on transcripts Segment Segment ending Transcript name starting position position T11628_PEA_1_T3 (SEQ ID NO: 678) 832 844 T11628_PEA_1_T4 (SEQ ID NO: 679) 817 829 T11628_PEA_1_T5 (SEQ ID NO: 680) 799 811 T11628_PEA_1_T7 (SEQ ID NO: 681) 784 796 T11628_PEA_1_T9 (SEQ ID NO: 682) 658 670 T11628_PEA_1_T11 (SEQ ID 874 886 NO: 683)

Segment cluster T11628_PEA.sub.--1_node.sub.--33 (SEQ ID NO:705) according to the present invention can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681), T11628_PEA.sub.--1_T9 (SEQ ID NO:682) and T11628_PEA.sub.--1_T11 (SEQ ID NO:683). Table 38 below describes the starting and ending position of this segment on each transcript. TABLE-US-01184 TABLE 38 Segment location on transcripts Segment Segment ending Transcript name starting position position T11628_PEA_1_T3 (SEQ ID NO: 678) 845 866 T11628_PEA_1_T4 (SEQ ID NO: 679) 830 851 T11628_PEA_1_T5 (SEQ ID NO: 680) 812 833 T11628_PEA_1_T7 (SEQ ID NO: 681) 797 818 T11628_PEA_1_T9 (SEQ ID NO: 682) 671 692 T11628_PEA_1_T11 (SEQ ID 887 908 NO: 683)

Segment cluster T11628_PEA.sub.--1_node.sub.--34 (SEQ ID NO:706) according to the present invention is supported by 122 libraries. The number of libraries was determined as previously described. This segment can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681), T11628_PEA1_T9 (SEQ ID NO:682) and T11628_PEA.sub.--1_T11 (SEQ ID NO:683). Table 39 below describes the starting and ending position of this segment on each transcript. TABLE-US-01185 TABLE 39 Segment location on transcripts Segment Segment ending Transcript name starting position position T11628_PEA_1_T3 (SEQ ID NO: 678) 867 911 T11628_PEA_1_T4 (SEQ ID NO: 679) 852 896 T11628_PEA_1_T5 (SEQ ID NO: 680) 834 878 T11628_PEA_1_T7 (SEQ ID NO: 681) 819 863 T11628_PEA_1_T9 (SEQ ID NO: 682) 693 737 T11628_PEA_1_T11 (SEQ ID 909 953 NO: 683)

Segment cluster T11628_PEA.sub.--1_node.sub.--35 (SEQ ID NO:707) according to the present invention is supported by 126 libraries. The number of libraries was determined as previously described. This segment can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681), T11628_PEA.sub.--1_T9 (SEQ ID NO:682) and T11628_PEA.sub.--1_T11 (SEQ ID NO:683). Table 40 below describes the starting and ending position of this segment on each transcript. TABLE-US-01186 TABLE 40 Segment location on transcripts Segment Segment ending Transcript name starting position position T11628_PEA_1_T3 (SEQ ID NO: 678) 912 967 T11628_PEA_1_T4 (SEQ ID NO: 679) 897 952 T11628_PEA_1_T5 (SEQ ID NO: 680) 879 934 T11628_PEA_1_T7 (SEQ ID NO: 681) 864 919

T11628_PEA__1_T9 (SEQ ID NO: 682) 738 793
T11628_PEA__1_T11 (SEQ ID 954 1009 NO: 683)

Segment cluster T11628_PEA.sub.--1_node.sub.--36 (SEQ ID NO:708) according to the present invention is supported by 122 libraries. The number of libraries was determined as previously described. This segment can be found in the following transcript(s): T11628_PEA.sub.--1_T3 (SEQ ID NO:678), T11628_PEA.sub.--1_T4 (SEQ ID NO:679), T11628_PEA.sub.--1_T5 (SEQ ID NO:680), T11628_PEA.sub.--1_T7 (SEQ ID NO:681), T11628_PEA.sub.--1_T9 (SEQ ID NO:682) and T11628_PEA.sub.--1_T11 (SEQ ID NO:683). Table 41 below describes the starting and ending position of this segment on each transcript. TABLE-US-01187 TABLE 41 Segment location on transcripts Segment Segment ending Transcript name starting position position T11628_PEA__1_T3 (SEQ ID NO: 678) 968 1085 T11628_PEA__1_T4 (SEQ ID NO: 679) 953 1070 T11628_PEA__1_T5 (SEQ ID NO: 680) 935 1052 T11628_PEA__1_T7 (SEQ ID NO: 681) 920 1037 T11628_PEA__1_T9 (SEQ ID NO: 682) 794 911 T11628_PEA__1_T11 (SEQ ID 1010 1127 NO: 683)

Variant Protein Alignment to the Previously Known Protein:
Sequence name: Q8WVH6 (SEQ ID NO:711)

Sequence Documentation:

Alignment of: T11628_PEA.sub.--1_P2 (SEQ ID NO:712).times.Q8WVH6 (SEQ ID NO:711).
Alignment segment 1/1: TABLE-US-01188 Quality: 962.00 Escore: 0 Matching length: 99 Total length: 99 Matching Percent 100.00 Matching Percent Identity: 100.00 Similarity: Total Percent Similarity: 100.00 Total Percent Identity: 100.00 Gaps: 0

```
Alignment: TABLE-US-01189 56
MKASEDLKKHGATVLTALGGILKKKGHHEAEIKPLAQSHATKHKIPVKYL    105
||||||||||||||||||||||||||||||||||||||||||||||||||      1
MKASEDLKKHGATVLTALGGILKKKGHHEAEIKPLAQSHATKHKIPVKYL    50  106

EFISECIIQVLQSKHPGDFGADAQGAMNKALELFRKDMASNYKELGFQG     154
||||||||||||||||||||||||||||||||||||||||||||||||       51
EFISECIIQVLQSKHPGDFGADAQGAMNKALELFRKDMASNYKELGFQG      99
```

Sequence name: MYG_HUMAN_V1 (SEQ ID NO:710)
Sequence Documentation:
Alignment of: T11628_PEA.sub.--1_P5 (SEQ ID NO:713).times.MYG_HUMAN_V1 (SEQ ID NO:710).
Alignment segment 1/1: TABLE-US-01190 Quality: 962.00 Escore: 0 Matching length: 99 Total length: 99 Matching Percent 100.00 Matching Percent Identity: 100.00 Similarity: Total Percent Similarity: 100.00 Total Percent Identity: 100.00 Gaps: 0

```
Alignment: TABLE-US-01191 1
MKASEDLKKHGATVLTALGGILKKKGHHEAEIKPLAQSHATKHKIPVKYL    50
||||||||||||||||||||||||||||||||||||||||||||||||||    56
MKASEDLKKHGATVLTALGGILKKKGHHEAEIKPLAQSHATKHKIPVKYL    105 51

EFISECIIQVLQSKHPGDFGADAQGAMNKALELFRKDMASNYKELGFQG     99
|||||||||||||||||||||||||||||||||||||||||||||||||    106
EFISECIIQVLQSKHPGDFGADAQGAMNKALELFRKDMASNYKELGFQG     154
```

Sequence name: MYG_HUMAN_V1 (SEQ ID NO:710)
Sequence Documentation:
Sequence of: T11628_PEA.sub.--1_P7 (SEQ ID NO:714).times.MYG_HUMAN_V1 (SEQ ID NO:710).
Alignment segment 1/1: TABLE-US-01192 Quality: 1315.00 Escore: 0 Matching length: 134 Total length: 134 Matching Percent 100.00 Matching Percent Identity: 100.00 Similarity: Total Percent Similarity: 100.00 Total Percent Identity: 100.00 Gaps: 0

```
Alignment: TABLE-US-01193 1
MGLSDGEWQLVLNVWGKVEADIPGHGQEVLIRLFKGHPETLEKFDKFKHL    50
||||||||||||||||||||||||||||||||||||||||||||||||||    1
MGLSDGEWQLVLNVWGKVEADIPGHGQEVLIRLFKGHPETLEKFDKFKHL    50  51

KSEDEMKASEDLKKHGATVLTALGGILKKKGHHEAEIKPLAQSHATKHKI    100
|||||||||||||||||||||||||||||||||||||||||||||||||    51
KSEDEMKASEDLKKHGATVLTALGGILKKKGHHEAEIKPLAQSHATKHKI    100 101

PVKYLEFISECIIQVLQSKHPGDFGADAQGAMNK    134
|||||||||||||||||||||||||||||||||    101
PVKYLEFISECIIQVLQSKHPGDFGADAQGAMNK    134
```

Sequence name: Q8WVH6 (SEQ ID NO:711)
Sequence Documentation:
Alignment of: T11628_PEA.sub.--1_P10 (SEQ ID NO:715).times.Q8WVH6 (SEQ ID NO:711).
Alignment segment 1/1: TABLE-US-01194 Quality: 962.00 Escore: 0 Matching length: 99 Total length: 99 Matching Percent 100.00 Matching Percent Identity: 100.00 Similarity: Total Percent Similarity: 100.00 Total Percent Identity: 100.00 Gaps: 0

```
Alignment: TABLE-US-01195 56
MKASEDLKKHGATVLTALGGILKKKGHHEAEIKPLAQSHATKHKIPVKYL    105
|||||||||||||||||||||||||||||||||||||||||||||||||    1
MKASEDLKKHGATVLTALGGILKKKGHHEAEIKPLAQSHATKHKIPVKYL    50  106

EFISECIIQVLQSKHPGDFGADAQGAMNKALELFRKDMASNYKELGFQG    154
||||||||||||||||||||||||||||||||||||||||||||||||    51
EFISECIIQVLQSKHPGDFGADAQGAMNKALELFRKDMASNYKELGFQG    99
```

Description for Cluster M78076

Cluster M78076 features 9 transcript(s) and 35 segment(s) of interest, the names for which are given in Tables 1 and 2, respectively, the sequences themselves are given at the end of the application. The selected protein variants are given in table 3. TABLE-US-01196 TABLE 1 Transcripts of interest Transcript Name Sequence ID No. M78076_PEA_1_T2 716 M78076_PEA_1_T3 717 M78076_PEA_1_T5 718 M78076_PEA_1_T13 719 M78076_PEA_1_T15 720 M78076_PEA_1_T23 721 M78076_PEA_1_T26 722 M78076_PEA_1_T27 723 M78076_PEA_1_T28 724

TABLE-US-01197 TABLE 2 Segments of interest Segment Name Sequence ID No. M78076_PEA_1_node_0 725 M78076_PEA_1_node_10 726 M78076_PEA_1_node_15 727 M78076_PEA_1_node_18 728 M78076_PEA_1_node_20 729 M78076_PEA_1_node_24 730 M78076_PEA_1_node_26 731 M78076_PEA_1_node_29 732 M78076_PEA_1_node_32 733 M78076_PEA_1_node_35 734 M78076_PEA_1_node_37 735 M78076_PEA_1_node_46 736 M78076_PEA_1_node_47 737 M78076_PEA_1_node_54 738 M78076_PEA_1_node_1 739 M78076_PEA_1_node_2 740 M78076_PEA_1_node_3 741 M78076_PEA_1_node_6 742 M78076_PEA_1_node_7 743 M78076_PEA_1_node_12 744 M78076_PEA_1_node_22 745 M78076_PEA_1_node_27 746 M78076_PEA_1_node_30 747 M78076_PEA_1_node_31 748 M78076_PEA_1_node_34 749 M78076_PEA_1_node_36 750 M78076_PEA_1_node_41 751 M78076_PEA_1_node_42 752 M78076_PEA_1_node_43 753 M78076_PEA_1_node_45 754 M78076_PEA_1_node_49 755 M78076_PEA_1_node_50 756 M78076_PEA_1_node_51 757 M78076_PEA_1_node_52 758 M78076_PEA_1_node_53 759

TABLE-US-01198 TABLE 3 Proteins of interest Sequence Protein Name ID No. Corresponding Transcript(s) M78076_PEA_1_P3 761 M78076_PEA_1_T2 (SEQ ID NO: 716); M78076_PEA_1_T5 (SEQ ID NO: 718) M78076_PEA_1_P4 762 M78076_PEA_1_T3 (SEQ ID NO: 717) M78076_PEA_1_P12 763 M78076_PEA_1_T13 (SEQ ID NO: 719) M78076_PEA_1_P14 764 M78076_PEA_1_T15 (SEQ ID NO: 720) M78076_PEA_1_P21 765 M78076_PEA_1_T23 (SEQ ID NO: 721) M78076_PEA_1_P24 766 M78076_PEA_1_T26 (SEQ ID NO: 722) M78076_PEA_1_P2 767 M78076_PEA_1_T27 (SEQ ID NO: 723) M78076_PEA_1_P25 768 M78076_PEA_1_T28 (SEQ ID NO: 724)

These sequences are variants of the known protein Amyloid-like protein 1 precursor (SwissProt accession identifier APP1_HUMAN; known also according to the synonyms APLP; APLP-1), SEQ ID NO: 760, referred to herein as the previously known protein.

Protein Amyloid-like protein 1 precursor (SEQ ID NO:760) is known or believed to have the following function(s): May play a role in postsynaptic function. The C-terminal gamma-secretase processed fragment, ALID1, activates transcription activation through APBB1 (Fe65) binding (By similarity). Couples to JIP signal transduction through C-terminal binding. May interact with cellular G-protein signaling pathways. Can regulate neurite outgrowth through binding to components of the extracellular matrix such as heparin and collagen 1. The gamma-CTF peptide, C30, is a potent enhancer of neuronal apoptosis (By similarity). The sequence for protein Amyloid-like protein 1 precursor (SEQ ID NO:760) is given at the end of the application, as "Amyloid-like protein 1 precursor (SEQ ID NO:760) amino acid sequence". Known polymorphisms for this sequence are as shown in Table 4. TABLE-US-01199 TABLE 4 Amino acid mutations for Known Protein SNP position(s) on amino acid sequence Comment 48 A→P Protein Amyloid-like protein 1 precursor (SEQ ID NO:760) localization is believed to be Type I membrane protein. C-terminally processed in the Golgi complex.

The following GO Annotation(s) apply to the previously known protein. The following annotation(s) were found: endocytosis; apoptosis; cell adhesion; neurogenesis; cell death, which are annotation(s) related to Biological Process;

protein binding; heparin binding, which are annotation(s) related to Molecular Function; and basement membrane; coated pit; integral membrane protein, which are annotation(s) related to Cellular Component.

The GO assignment relies on information from one or more of the SwissProt/TremBl Protein knowledgebase, available from expasy.ch/sprot/; or Locuslink, available from ncbi.nlm.nih.gov/projects/LocusLink/.

As noted above, cluster M78076 features 9 transcript(s), which were listed in Table 1 above. These transcript(s) encode for protein(s) which are variant(s) of protein Amyloid-like protein 1 precursor (SEQ ID NO:760). A description of each variant protein according to the present invention is now provided.

Variant protein M78076_PEA.sub.--1_P3 (SEQ ID NO:761) according to the present invention has an amino acid sequence as given at the end of the application; it is encoded by transcript(s) M78076_PEA.sub.--1_T2 (SEQ ID NO:716). An alignment is given to the known protein (Amyloid-like protein 1 precursor (SEQ ID NO:760)) at the end of the application. One or more alignments to one or more previously published protein sequences are given at the end of the application. A brief description of the relationship of the variant protein according to the present invention to each such aligned protein is as follows:

Comparison report between M78076_PEA.sub.--1_P3 (SEQ ID NO:761) and APP1_HUMAN (SEQ ID NO:760):

1. An isolated chimeric polypeptide encoding for M78076_PEA.sub.--1_P3 (SEQ ID NO:761), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQIQELLHSEHLGPSE-LEAPAPGGSSEDKGGLQPPDSKD corresponding to amino acids 1-517 of APP1_HUMAN (SEQ ID NO:760), which also corresponds to amino acids 1-517 of M78076_PEA.sub.--1_P3 (SEQ ID NO:761), and a second amino acid sequence being at least 70%, optionally at least 80%, preferably at least 85%, more preferably at least 90% and most preferably at least 95% homologous to a polypeptide having the sequence GE corresponding to amino acids 518-519 of M78076_PEA.sub.--1_P3 (SEQ ID NO:761), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA.sub.--1_P3 (SEQ ID NO:761) also has the following non-silent SNPs (Single Nucleotide Polymorphisms) as listed in Table 5, (given according to their position(s) on the amino acid sequence, with the alternative amino acid(s) listed; the last column indicates whether the SNP is known or not; the presence of known SNPs in variant protein M78076_PEA.sub.--1_P3 (SEQ ID NO:761) sequence provides support for the deduced sequence of this variant protein according to the present invention). TABLE-US-01200 TABLE 5 Amino acid mutations SNP position(s) on Alternative Previously amino acid sequence amino acid(s) known SNP? 4 A→P Yes 6 P→H Yes 13 R→H Yes 34 Q→No 38 G→R Yes 88 P→R Yes 124 R→Q Yes 127 S→No 145 F→S No 214 G→R No 214 G→No 262 Q→No 270 V→No 309 G→E Yes 370 Q→No The glycosylation sites of variant protein M78076_PEA.sub.--1_P3 (SEQ ID NO:761), as compared to the known protein Amyloid-like protein 1 precursor (SEQ ID NO:760), are described in Table 6 (given according to their position(s) on the amino acid sequence in the first column; the second column indicates whether the glycosylation site is present in the variant protein; and the last column indicates whether the position is different on the variant protein). TABLE-US-01201 TABLE 6 Glycosylation site(s) Position(s) on known amino Present in Position acid sequence variant protein? in variant protein? 337 yes 337 461 yes 461 551 no Variant protein M78076_PEA.sub.--1_P3 (SEQ ID NO:761) is encoded by the following transcript(s): M78076_PEA.sub.--1_T2 (SEQ ID NO:716), for which the sequence(s) is/are given at the end of the application. The coding portion of transcript M78076_PEA.sub.--1_T2 (SEQ ID NO:716) is shown in bold; this coding portion starts at position 142 and ends at position 1698. The transcript also has the following SNPs as listed in Table 7 (given according to their position on the nucleotide sequence, with the alternative nucleic acid listed; the last column indicates whether the SNP is known or not; the presence of known SNPs in variant protein M78076_PEA.sub.--1_P3 (SEQ ID NO:761) sequence provides support for the deduced sequence of this variant protein according to the present invention). TABLE-US-01202 TABLE 7 Nucleic acid SNPs SNP position on nucleotide Alternative sequence nucleic acid Previously known SNP? 114 G→No 151 G→C Yes 158 C→A Yes 179 G→A Yes 219 A→G Yes 243 G→No 253 G→A Yes 315 A→G Yes 366 A→G Yes 404 C→G Yes 512 G→A Yes 522 C→No 522 C→T No 575 T→C No 781 G→No 781 G→A No 927 G→No 951 C→No 1067 G→A Yes 1077 G→A Yes 1251 G→No 1398 G→T Yes 1423 C→T Yes 2146 G→A Yes 2224 C→T No 2362 C→T Yes 2513 A→G No 2656 C→T Yes Variant protein M78076_PEA.sub.--1_P4 (SEQ ID NO:762) according to the present invention has an amino acid sequence as given at the end of the application; it is encoded by transcript(s) M78076_PEA.sub.--1_T3 (SEQ ID NO:717). An alignment is given to the known protein (Amyloid-like protein 1 precursor (SEQ ID NO:760)) at the end of the application. One or more alignments to one or more previously published protein sequences are given at the end of the application. A brief description of the relationship of the variant protein according to the present invention to each such aligned protein is as follows:

Comparison report between M78076_PEA.sub.--1_P4 (SEQ ID NO:762) and APP1_HUMAN (SEQ ID NO:760):

1. An isolated chimeric polypeptide encoding for M78076_PEA.sub.--1_P4 (SEQ ID NO:762), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQIQELLHSEHLGPSE-LEAPAPGGSSEDKGGLQPPDSKDDTPMTLPKG corresponding to amino acids 1-526 of APP1_HUMAN (SEQ ID NO:760), which also corresponds to amino acids 1-526 of M78076_PEA.sub.--1_P4 (SEQ ID NO:762), and a second amino acid sequence being at least 70%, optionally at least 80%, preferably at least 85%, more preferably at least 90% and most preferably at least 95% homologous to a polypeptide having the sequence ECLTVNPSLQIPLNP (SEQ ID NO:958) corresponding to amino acids 527-541 of M78076_PEA.sub.--1_P4 (SEQ ID NO:762), wherein said first amino acid sequence and second amino acid sequence are contiguous and in a sequential order.

2. An isolated polypeptide encoding for a tail of M78076_PEA.sub.--1_P4 (SEQ ID NO:762), comprising a polypeptide being at least 70%, optionally at least about 80%, preferably at least about 85%, more preferably at least about 90% and most preferably at least about 95% homologous to the sequence ECLTVNPSLQIPLNP (SEQ ID NO:958) in M78076_PEA.sub.--1_P4 (SEQ ID NO:762).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA.sub.--1_P4 (SEQ ID NO:762) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein M78076_PEA.sub.--1_P4 (SEQ ID NO:762) sequence provides support for the deduced sequence of this variant protein according to the present invention). TABLE-US-01203 TABLE 8 Amino acid mutations SNP position(s) on amino acid Alternative sequence amino acid(s) Previously known SNP? 4 A→P Yes 6 P→H Yes 13 R→H Yes 34 Q→No 38 G→R Yes 88 P→R Yes 124 R→Q Yes 127 S→No 145 F→S No 214 G→R No 214 G→No 262 Q→No 270 V→No 309 G→E Yes 370 Q→No The glycosylation sites of variant protein M78076_PEA.sub.--1_P4 (SEQ ID NO:762), as compared to the known protein Amyloid-like protein 1 precursor (SEQ ID NO:760), are described in Table 9 (given according to their position(s) on the amino acid sequence in the first column; the second column indicates whether the glycosylation site is present in the variant protein; and the last column indicates whether the position is different on the variant protein). TABLE-US-01204 TABLE 9 Glycosylation site(s) Position (s) on known amino Present in Position acid sequence variant protein? in variant protein? 337 yes 337 461 yes 461 551 no Variant protein M78076_PEA.sub.--1_P4 (SEQ ID NO:762) is encoded by the following transcript(s): M78076_PEA.sub.--1_T3 (SEQ ID NO:717), for which the sequence(s) is/are given at the end of the application. The coding portion of transcript M78076_PEA.sub.--1_T3 (SEQ ID NO:717) is shown in bold; this coding portion starts at position 142 and ends at position 1764. The transcript also has the following SNPs as listed in Table 10 (given according to their position on the nucleotide sequence, with the alternative nucleic acid listed; the last column indicates whether the SNP is known or not; the presence of known SNPs in variant protein M78076_PEA.sub.--1_P4 (SEQ ID NO:762) sequence provides support for the deduced sequence of this variant protein according to the present invention). TABLE-US-01205 TABLE 10 Nucleic acid SNPs SNP position on nucleotide Alternative sequence nucleic acid Previously known SNP? 114 G→No 151 G→C Yes 158 C→A Yes 179 G→A Yes 219 A→G Yes 243 G→No 253 G→A Yes 315 A→G Yes 366 A→G Yes 404 C→G Yes 512 G→A Yes 522 C→No 522 C→T No 575 T→C No 781 G→No 781 G→A No 927 G→No 951 C→No 1067 G→A Yes 1077 G→A Yes 1251 G→No 1398 G→T Yes 1423 C→T Yes 1817 G→A Yes 2362 G→A Yes 2440 C→T No 2578 C→T Yes 2729 A→G No 2872 C→T Yes Variant protein M78076_PEA.sub.--1_P12 (SEQ ID NO:763) according to the present invention has an amino acid sequence as given at the end of the application; it is encoded by transcript(s) M78076_PEA.sub.--1_T13 (SEQ ID NO:719). An alignment is given to the known protein (Amyloid-like protein 1 precursor (SEQ ID NO:760)) at the end of the application. One or more alignments to one or more previously published protein sequences are given at the end of the application. A brief description of the relationship of the variant protein according to the present invention to each such aligned protein is as follows:

Comparison report between M78076_PEA.sub.--1_P12 (SEQ ID NO:763) and APP1_HUMAN (SEQ ID NO:760):

1. An isolated chimeric polypeptide encoding for M78076_PEA.sub.--1_P12 (SEQ ID NO:763), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQIQELLHSEHLGPSELEAPAPGGSSEDKGGLQPPDSKDDTPMTLPKG corresponding to amino acids 1-526 of APP1_HUMAN (SEQ ID NO:760), which also corresponds to amino acids 1-526 of M78076_PEA.sub.--1_P12 (SEQ ID NO:763), and a second amino acid sequence being at least 70%, optionally at least 80%, preferably at least 85%, more preferably at least 90% and most preferably at least 95% homologous to a polypeptide having the sequence ECVCSKGFPFPLIGDSEG (SEQ ID NO:959) corresponding to amino acids 527-544 of M78076_PEA.sub.--1_P12 (SEQ ID NO:763), wherein said first amino acid sequence and second amino acid sequence are contiguous and in a sequential order.

2. An isolated polypeptide encoding for a tail of M78076_PEA.sub.--1_P12 (SEQ ID NO:763), comprising a polypeptide being at least 70%, optionally at least about 80%, preferably at least about 85%, more preferably at least about 90% and most preferably at least about 95% homologous to the sequence ECVCSKGFPFPLIGDSEG (SEQ ID NO:959) in M78076_PEA.sub.--1_P12 (SEQ ID NO:763).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA.sub.--1_P12 (SEQ ID NO:763) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein M78076_PEA.sub.--1_P12 (SEQ ID NO:763) sequence provides support for the deduced sequence of this variant protein according to the present invention). TABLE-US-01206 TABLE 11 Amino acid mutations SNP position(s) on amino acid Alternative sequence amino acid(s) Previously known SNP? 4 A→P Yes 6 P→H Yes 13 R→H Yes 34 Q→No 38 G→R Yes 88 P→R Yes 124 R→Q Yes 127 S→No 145 F→S No 214 G→R No 214 G→No 262 Q→No 270 V→No 309 G→E Yes 370 Q→No The glycosylation sites of variant protein M78076_PEA.sub.--1_P12 (SEQ ID NO:763), as compared to the known protein Amyloid-like protein 1 precursor (SEQ ID NO:760), are described in Table 12 (given according to their position(s) on the amino acid sequence in the first column; the second column indicates whether the glycosylation site is present in the variant protein; and the last column indicates whether the position is different on the variant protein). TABLE-US-01207 TABLE 12 Glycosylation site(s) Position(s) on known amino Present in Position acid sequence variant protein? in variant protein? 337 yes 337 461 yes 461 551 no Variant protein M78076_PEA.sub.--1_P12 (SEQ ID NO:763) is encoded by the following transcript(s): M78076_PEA.sub.--1_T13 (SEQ ID NO:719), for which the sequence(s) is/are given at the end of the application. The coding portion of transcript M78076_PEA.sub.--1_T13 (SEQ ID NO:719) is shown in bold; this coding portion starts at position 142 and ends at position 1773. The transcript also has the following SNPs as listed in Table 13 (given according to their position on the nucleotide sequence, with the alternative nucleic acid listed; the last column indicates whether the SNP is known or not; the presence of known SNPs in variant protein M78076_PEA.sub.--1_P12 (SEQ ID NO:763) sequence provides support for the deduced sequence of this variant protein according to the present invention). TABLE-US-01208 TABLE 13 Nucleic acid SNPs SNP position on nucleotide Alternative sequence nucleic acid Previously known SNP? 114 G→No 151 G→C Yes 158 C→A Yes 179 G→A Yes 219 A→G Yes 243 G→No 253 G→A Yes 315 A→G Yes 366 A→G Yes 404 C→G Yes 512 G→A Yes 522 C→No 522 C→T No 575 T→C No 781 G→No 781 G→A No 927 G→No 951 C→No 1067 G→A Yes 1077 G→A Yes 1251 G→No 1398 G→T Yes 1423 C→T Yes 1816 G→A Yes 1894 C→T No 2032 C→T Yes 2183 A→G No 2326 C→T Yes Variant protein M78076_PEA.sub.--1_P14 (SEQ ID NO:764) according to the present invention has an amino acid sequence as given at the end of the application; it is encoded by transcript(s) M78076_PEA.sub.--1_T15 (SEQ ID NO:720). An alignment is given to the known protein (Amyloid-like protein 1 precursor (SEQ ID NO:760)) at the end of the application. One or more alignments to one or more previously published protein sequences are given at the end of the application. A brief description of the relationship of the variant protein according to the present invention to each such aligned protein is as follows:

Comparison report between M78076_PEA.sub.--1_P14 (SEQ ID NO:764) and APP1_HUMAN (SEQ ID NO:760):

1. An isolated chimeric polypeptide encoding for M78076_PEA.sub.--1_P14 (SEQ ID NO:764), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQIQELLHSEHLGPSE-LEAPAPGGSSEDKGGLQPPDSKDDTPMTLPKGST EQDAASPEKEKMNPLEQYERKVNAS-VPRGFPFHSSEIQRDEL corresponding to amino acids 1-570 of APP1_HUMAN (SEQ ID NO:760), which also corresponds to amino acids 1-570 of M78076_PEA.sub.--1_P14 (SEQ ID NO:764), and a second amino acid sequence being at least 70%, optionally at least 80%, preferably at least 85%, more preferably at least 90% and most preferably at least 95% homologous to a polypeptide having the sequence VRGGTAGYLGEETRGQRPGCDSQSHT-GPSKKPSAPSPLPAGTSWDRGVP (SEQ ID NO:960) corresponding to amino acids 571-619 of M78076_PEA.sub.--1_P14 (SEQ ID NO:764), wherein said first amino acid sequence and second amino acid sequence are contiguous and in a sequential order.

2. An isolated polypeptide encoding for a tail of M78076_PEA.sub.--1_P14 (SEQ ID NO:764), comprising a polypeptide being at least 70%, optionally at least about 80%, preferably at least about 85%, more preferably at least about 90% and most preferably at least about 95% homologous to the sequence TABLE-US-01209 VRGGTAGYL- GEETRGQRPGCDSQSHTGPSKKP-SAPSPLPAGTSWDRGVP (SEQ ID NO:960) in M78076_PEA.sub.--1_P14. (SEQ ID NO:764)

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA.sub.--1_P14 (SEQ ID NO:764) also has the following non-silent SNPs (Single Nucleotide Polymorphisms) as listed in Table 14, (given according to their position(s) on the amino acid sequence, with the alternative amino acid(s) listed; the last column indicates whether the SNP is known or not; the presence of known SNPs in variant protein M78076_PEA.sub.--1_P14 (SEQ ID NO:764) sequence provides support for the deduced sequence of this variant protein according to the present invention). TABLE-US-01210 TABLE 14 Amino acid mutations SNP position(s) on amino acid Alternative sequence amino acid(s) Previously known SNP? 4 A→P Yes 6 P→H Yes 13 R→H Yes 34 Q→No 38 G→R Yes 88 P→R Yes 124 R→Q Yes 127 S→No 145 F→S No 214 G→R No 214 G→No 262 Q→No 270 V→No 309 G→E Yes 370 Q→No The glycosylation sites of variant protein M78076_PEA.sub.--1_P14 (SEQ ID NO:764), as compared to the known protein Amyloid-like protein 1 precursor (SEQ ID NO:760), are described in Table 15 (given according to their position(s) on the amino acid sequence in the first column; the second column indicates whether the glycosylation site is present in the variant protein; and the last column indicates whether the position is different on the variant protein). TABLE-US-01211 TABLE 15 Glycosylation site(s) Position(s) on known amino Present in Position acid sequence variant protein? in variant protein? 337 yes 337 461 yes 461 551 yes 551

Variant protein M78076_PEA.sub.--1_P14 (SEQ ID NO:764) is encoded by the following transcript(s): M78076_PEA.sub.--1_T15 (SEQ ID NO:720), for which the sequence(s) is/are given at the end of the application. The coding portion of transcript M78076_PEA.sub.--1_T15 (SEQ ID NO:720) is shown in bold; this coding portion starts at position 142 and ends at position 1998. The transcript also has the following SNPs as listed in Table 16 (given according to their position on the nucleotide sequence, with the alternative nucleic acid listed; the last column indicates whether the SNP is known or not; the presence of known SNPs in variant protein M78076_PEA.sub.--1_P14 (SEQ ID NO:764) sequence provides support for the deduced sequence of this variant protein according to the present invention). TABLE-US-01212 TABLE 16 Nucleic acid SNPs SNP position on nucleotide Alternative sequence nucleic acid Previously known SNP? 114 G→No 151 G→C Yes 158 C→A Yes 179 G→A Yes 219 A→G Yes 243 G→No 253 G→A Yes 315 A→G Yes 366 A→G Yes 404 C→G Yes 512 G→A Yes 522 C→No 522 C→T No 575 T→C No 781 G→No 781 G→A No 927 G→No 951 C→No 1067 G→A Yes 1077 G→A Yes 1251 G→No 1398 G→T Yes 1423 C→T Yes 2008 G→A Yes 2086 C→T No 2224 C→T Yes 2375 A→G No 2518 C→T Yes Variant protein M78076_PEA.sub.--1_P21 (SEQ ID NO:765) according to the present invention has an amino acid sequence as given at the end of the application; it is encoded by transcript(s) M78076_PEA.sub.--1_T23 (SEQ ID NO:721). An alignment is given to the known protein (Amyloid-like protein 1 precursor (SEQ ID NO:760)) at the end of the application. One or more alignments to one or more previously published protein sequences are given at the end of the application. A brief description of the relationship of the variant protein according to the present invention to each such aligned protein is as follows:

Comparison report between M78076_PEA.sub.--1_P21 (SEQ ID NO:765) and APP1_HUMAN (SEQ ID NO:760):

1. An isolated chimeric polypeptide encoding for M78076_PEA.sub.--1_P21 (SEQ ID NO:765), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALNE corresponding to amino acids 1-352 of APP1_HUMAN (SEQ ID NO:760), which also corresponds to amino acids 1-352 of M78076_PEA.sub.--1_P21 (SEQ ID NO:765), and a second amino acid sequence being at least 90% homologous to AERVLLALRRYLRAEQKEQRHTLRHYQH-VAAVDPEKAQQMRFQVHTHLQVIEERVNQ SLGLL-DQNPHLAQELRPQIQELLHSEHLGPSE-LEAPAPGGSSEDKGGLQPPDSKDDTPMT LPKGSTEQDMSPEKEKMNPLEQYERKV-NASVPRGFPFHSSEIQRDELAPAGTGVSREA VSGLLIMGAGGGSLIVLSMLLLR-RKKPYGAISHGWEVDPMLTLEEQQLRELQRHGYE NPTYRFLEERP corresponding to amino acids 406-650 of APP1_HUMAN (SEQ ID NO:760), which also corresponds to amino acids 353-597 of M78076_PEA.sub.--1_P21 (SEQ ID NO:765), wherein said first amino acid sequence and second amino acid sequence are contiguous and in a sequential order.

2. An isolated chimeric polypeptide encoding for an edge portion of M78076_PEA.sub.--1_P21 (SEQ ID NO:765), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 352-x to 352; and ending at any of amino acid numbers 353+((n−2)-x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein M78076_PEA.sub.--1_P21 (SEQ ID NO:765) also has the following non-silent SNPs (Single Nucleotide Polymorphisms) as listed in Table 17, (given according to their position(s) on the amino acid sequence, with the alternative amino acid(s) listed; the last column indicates whether the SNP is known or not; the presence of known SNPs in variant protein M78076_PEA.sub.--1_P21 (SEQ ID NO:765) sequence provides support for the deduced sequence of this variant protein according to the present invention). TABLE-US-01213 TABLE 17 Amino acid mutations SNP position(s) on amino acid Alternative sequence amino acid(s) Previously known SNP? 4 A→P Yes 6 P→H Yes 13 R→H Yes 34 Q→No 38 G→R Yes 88 P→R Yes 124 R→Q Yes 127 S→No 145 F→S No 214 G→R No 214 G→No 262 Q→No 270 V→No 309 G→E Yes The glycosylation sites of variant protein M78076_PEA.sub.--1_P21 (SEQ ID NO:765), as compared to the known protein Amyloid-like protein 1 precursor (SEQ ID NO:760), are described in Table 18 (given according to their position(s) on the amino acid sequence in the first column; the second column indicates whether the glycosylation site is present in the variant protein; and the last column indicates whether the position is different on the variant protein). TABLE-US-01214 TABLE 18 Glycosylation site(s) Position(s) on known amino Present in Position acid sequence variant protein? in variant protein? 337 yes 337 461 yes 408 551 yes 498

Variant protein M78076_PEA.sub.--1_P21 (SEQ ID NO:765) is encoded by the following transcript(s): M78076_PEA.sub.--1_T23 (SEQ ID NO:721), for which the sequence(s) is/are given at the end of the application. The coding portion of transcript M78076_PEA.sub.--1_T23 (SEQ ID NO:721) is shown in bold; this coding portion starts at position 142 and ends at position 1932. The transcript also has the following SNPs as listed in Table 19 (given according to their position on the nucleotide sequence, with the alternative nucleic acid listed; the last column indicates whether the SNP is known or not; the presence of known SNPs in variant protein M78076_PEA.sub.--1_P21 (SEQ ID NO:765) sequence provides support for the deduced sequence of this variant protein according to the present invention). TABLE-US-01215 TABLE 19 Nucleic acid SNPs SNP position on nucleotide Alternative sequence nucleic acid Previously known SNP? 114 G→No 151 G→C Yes 158 C→A Yes 179 G→A Yes 219 A→G Yes 243 G→No 253 G→A Yes 315 A→G Yes 366 A→G Yes 404 C→G Yes 512 G→A Yes 522 C→No 522 C→T No 575 T→C No 781 G→No 781 G→A No 927 G→No 951 C→No 1067 G→A Yes 1077 G→A Yes 1239 G→T Yes 1264 C→T Yes 1728 G→A Yes 1806 C→T No 1944 C→T Yes 2095 A→G No 2238 C→T Yes Variant protein M78076_PEA.sub.--1_P24 (SEQ ID NO:766) according to the present invention has an amino acid sequence as given at the end of the application; it is encoded by transcript(s) M78076_PEA.sub.--1_T26 (SEQ ID NO:722). An alignment is given to the known protein (Amyloid-like protein 1 precursor (SEQ ID NO:760)) at the end of the application. One or more alignments to one or more previously published protein sequences are given at the end of the application. A brief description of the relationship of the variant protein according to the present invention to each such aligned protein is as follows:

Comparison report between M78076_PEA.sub.--1_P24 (SEQ ID NO:766) and APP1_HUMAN (SEQ ID NO:760):

1. An isolated chimeric polypeptide encoding for M78076_PEA.sub.--1_P24 (SEQ ID NO:766), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQI corresponding to amino acids 1-481 of APP1_HUMAN (SEQ ID NO:760), which also corresponds to amino acids 1-481 of M78076_PEA.sub.--1_P24 (SEQ ID NO:766), and a second amino acid sequence being at least 70%, optionally at least 80%, preferably at least 85%, more preferably at least 90% and most preferably at least 95% homologous to a polypeptide having the sequence RECLL-PWLPLQISEGRS (SEQ ID NO:961) corresponding to amino acids 482-498 of M78076_PEA.sub.--1.sub.P24 (SEQ ID NO:766), wherein said first amino acid sequence and second amino acid sequence are contiguous and in a sequential order.

2. An isolated polypeptide encoding for a tail of M78076_PEA.sub.--1_P24 (SEQ ID NO:766), comprising a polypeptide being at least 70%, optionally at least about 80%, preferably at least about 85%, more preferably at least about 90% and most preferably at least about 95% homologous to the sequence RECLLPWLPLQISEGRS (SEQ ID NO:961) in M78076_PEA.sub.--1_P24 (SEQ ID NO:766).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA.sub.--1_P24 (SEQ ID NO:766) also has the following non-silent SNPs (Single Nucleotide Polymorphisms) as listed in Table 20, (given according to their position(s) on the amino acid sequence, with the alternative amino acid(s) listed; the last column indicates whether the SNP is known or not; the presence of known SNPs in variant protein M78076_PEA.sub.--1_P24 (SEQ ID NO:766) sequence provides support for the deduced sequence of this variant protein according to the present invention). TABLE-US-01216 TABLE 20 Amino acid mutations SNP position(s) on amino acid Alternative sequence amino acid(s) Previously known SNP? 4 A→P Yes 6 P→H Yes 13 R→H Yes 34 Q→No 38 G→R Yes 88 P→R Yes 124 R→Q Yes 127 S→No 145 F→S No 214 G→R No 214 G→No 262 Q→No 270 V→No 309 G→E Yes 370 Q→No The glycosylation sites of variant protein M78076_PEA.sub.--1_P24 (SEQ ID NO:766), as compared to the known protein Amyloid-like protein 1 precursor (SEQ ID NO:760), are described in Table 21 (given according to their position(s) on the amino acid sequence in the first column; the second column indicates whether the glycosylation site is present in the variant protein; and the last column indicates whether the position is different on the variant protein). TABLE-US-01217 TABLE 21 Glycosylation site(s) Position(s) on known amino Present in Position acid sequence variant protein? in variant protein? 337 yes 337 461 yes 461 551 no Variant protein M78076_PEA.sub.--1_P24 (SEQ ID NO:766) is encoded by the following transcript(s): M78076_PEA.sub.--1_T26 (SEQ ID NO:722), for which the sequence(s) is/are given at the end of the application. The coding portion of transcript M78076_PEA.sub.--1_T26 (SEQ ID NO:722) is shown in bold; this coding portion starts at position 142 and ends at position 1635. The transcript also has the following SNPs as listed in Table 22 (given according to their position on the nucleotide sequence, with the alternative nucleic acid listed; the last column indicates whether the SNP is known or not; the presence of known SNPs in variant protein M78076_PEA.sub.--1_P24 (SEQ ID NO:766) sequence provides support for the deduced sequence variant protein according to the present invention). TABLE-US-01218 TABLE 22 Nucleic acid SNPs SNP position on nucleotide Alternative sequence nucleic acid Previously known SNP? 114 G→No 151 G→C Yes 158 C→A Yes 179 G→A Yes 219 A→G Yes 243 G→No 253 G→A Yes 315 A→G Yes 366 A→G Yes 404 C→G Yes 512 G→A Yes 522 C→No 522 C→T No 575 T→C No 781 G→No 781 G→A No 927 G→No 951 C→No 1067 G→A Yes 1077 G→A Yes 1251 G→No 1398 G→T Yes 1423 C→T Yes 2184 G→A Yes Variant protein M78076_PEA.sub.--1_P2 (SEQ ID NO:767) according to the present invention has an amino acid sequence as given at the end of the application; it is encoded by transcript(s) M78076_PEA.sub.--1_T27 (SEQ ID NO:723). An alignment is given to the known protein (Amyloid-like protein 1 precursor (SEQ ID NO:760)) at the end of the application. One or more alignments to one or more previously published protein sequences are given at the end of the application. A brief description of the relationship of the variant protein according to the present invention to each such aligned protein is as follows:

Comparison report between M78076_PEA.sub.--1_P2 (SEQ ID NO:767) and APP1_HUMAN (SEQ ID NO:760):

1. An isolated chimeric polypeptide encoding for M78076_PEA.sub.--1_P2 (SEQ ID NO:767), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQV corresponding to amino acids 1-449 of APP1_HUMAN (SEQ ID NO:760), which also corresponds to amino acids 1-449 of M78076_PEA.sub.--1_P2 (SEQ ID NO:767), and a second amino acid sequence being at least 70%, optionally at least 80%, preferably at least 85%, more preferably at least 90% and most preferably at least 95% homologous to a polypeptide having the sequence LTSFQLP-NAPLFLRRPRLRLFSCPLDPLS-VSWTPSYPLNTASLPLPSLSAQLPDPETWTLT CCVFD-PCFLALGFLLPPPSILCSVPWIFTAFPRIVFFFFFFLRQ VLALSPRQESSVRSWLIAT STSWVQAILLPQPLE (SEQ ID NO:962) corresponding to amino acids 450-588 of M78076_PEA.sub.--1_P2 (SEQ ID NO:767), wherein said first amino acid sequence and second amino acid sequence are contiguous and in a sequential order.

2. An isolated polypeptide encoding for a tail of M78076_PEA.sub.--1_P2 (SEQ ID NO:767), comprising a polypeptide being at least 70%, optionally at least about 80%, preferably at least about 85%, more preferably at least about 90% and most preferably at least about 95% homologous to the sequence TABLE-US-01219 LTSFQLPNAPLFLR-RPRLRLFSCPLDPLSVSWTPSYPLN-TASLPLPSLSAQLPDPETWTLT (SEQ ID NO:962) CCVFDPCFLALGFLLPPPSILCSVP-WIFTAFPRIVFFFFFFLRQVLALSPRQESSVRSWLIAT STSWVQAILLPQPLE in M78076_PEA__1_P2. (SEQ ID NO:767)

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein M78076_PEA.sub.--1_P2 (SEQ ID NO:767) also has the following non-silent SNPs (Single Nucleotide Polymorphisms) as listed in Table 23, (given according to their position(s) on the amino acid sequence, with the alternative amino acid(s) listed; the last column indicates whether the SNP is known or not; the presence of known SNPs in variant protein M78076_PEA.sub.--1_P2 (SEQ ID NO:767) sequence provides support for the deduced sequence of this variant protein according to the present invention). TABLE-US-01220 TABLE 23 Amino acid mutations SNP position(s) on amino acid Alternative sequence amino acid(s) Previously known SNP? 4 A→P Yes 6 P→H Yes 13 R→H Yes 34 Q→No 38 G→R Yes 88 P→R Yes 124 R→Q Yes 127 S→No 145 F→S No 214 G→R No 214 G→No 262 Q→No 270 V→No 309 G→E Yes 370 Q→No 520 A→S Yes 546 F→Yes 564 S→C Yes The glycosylation sites of variant protein M78076_PEA.sub.--1_P2 (SEQ ID NO:767), as compared to the known protein Amyloid-like protein 1 precursor (SEQ ID NO:760), are described in Table 24 (given according to their position(s) on the amino acid sequence in the first column; the second column indicates whether the glycosylation site is present in the variant protein; and the last column indicates whether the position is different on the variant protein). TABLE-US-01221 TABLE 24 Glycosylation site(s) Position(s) on known amino Present in Position acid sequence variant protein? in variant protein? 337 yes 337 461 no 551 no Variant protein M78076_PEA.sub.--1_P2 (SEQ ID NO:767) is encoded by the following transcript(s): M78076_PEA.sub.--1_T27 (SEQ ID NO:723), for which the sequence(s) is/are given at the end of the application. The coding portion of transcript M78076_PEA.sub.--1_T27 (SEQ ID NO:723) is shown in bold; this coding portion starts at position 142 and ends at position 1905. The transcript also has the following SNPs as listed in Table 25 (given according to their position on the nucleotide sequence, with the alternative nucleic acid listed; the last column indicates whether the SNP is known or not; the presence of known SNPs in variant protein M78076_PEA.sub.--1_P2 (SEQ ID NO:767) sequence provides support for the deduced sequence of this variant protein according to the present invention). TABLE-US-01222 TABLE 25 Nucleic acid SNPs SNP position on nucleotide Alternative sequence nucleic acid Previously known SNP? 114 G→No 151 G→C Yes 158 C→A Yes 179 G→A Yes 219 A→G Yes 243 G→No 253 G→A Yes 315 A→G Yes 366 A→G Yes 404 C→G Yes 512 G→A Yes 522 C→No 522 C→T No 575 T→C No 781 G→No 781 G→A No 927 G→No 951 C→No 1067 G→A Yes 1077 G→A Yes 1251 G→No 1398 G→T Yes 1423 C→T Yes 1500 C→T Yes 1699 G→T Yes 1725 G→A Yes 1777 T→Yes 1831 A→T Yes 2274 A→G Yes 2525 A→G Yes 2681 G→A Yes 3831 G→A Yes Variant protein M78076_PEA.sub.--1_P25 (SEQ ID NO:768) according to the present invention has an amino acid sequence as given at the end of the application; it is encoded by transcript(s) M78076_PEA.sub.--1_T28 (SEQ ID NO:724). An alignment is given to the known protein (Amyloid-like protein 1 precursor (SEQ ID NO:760)) at the end of the application. One or more alignments to one or more previously published protein sequences are given at the end of the application. A brief description of the relationship of the variant protein according to the present invention to each such aligned protein is as follows:

Comparison report between M78076_PEA.sub.--1_P25 (SEQ ID NO:768) and APP1_HUMAN (SEQ ID NO:760):

1. An isolated chimeric polypeptide encoding for M78076_PEA.sub.--1_P25 (SEQ ID NO:768), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIYFGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQ corresponding to amino acids 1-448 of APP1_HUMAN (SEQ ID NO:760), which also corresponds to amino acids 1-448 of M78076_PEA.sub.--1_P25 (SEQ ID NO:768), and a second amino acid sequence being at least 70%, optionally at least 80%, preferably at least 85%, more preferably at least 90% and most preferably at least 95% homologous to a polypeptide having the sequence PQNPN-SQPRAAGSLEVIISHPFVRRLEIL-ISPFQFQNSIPKNSQIVPMSPRGTSSP (SEQ ID NO:963) corresponding to amino acids 449-505 of M78076_PEA.sub.--1_P25 (SEQ ID NO:768), wherein said first amino acid sequence and second amino acid sequence are contiguous and in a sequential order.

2. An isolated polypeptide encoding for a tail of M78076_PEA.sub.--1_P25 (SEQ ID NO:768), comprising a polypeptide being at least 70%, optionally at least about 80%, preferably at least about 85%, more preferably at least about 90% and most preferably at least about 95% homologous to the sequence TABLE-US-01223 PQNPNSQPRAAGSLEVI-ISHPFVRRLEILISPFQFQNSIPKNSQIVPMSPRGTSSP (SEQ ID NO:963) in M78076_PEA_1_P25. (SEQ ID NO:768)

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA.sub.--1_P25 (SEQ ID NO:768) also has the following non-silent SNPs (Single Nucleotide Polymorphisms) as listed in Table 26, (given according to their position(s) on the amino acid sequence, with the alternative amino acid(s) listed; the last column indicates whether the SNP is known or not; the presence of known SNPs in variant protein M78076_PEA.sub.--1_P25 (SEQ ID NO:768) sequence provides support for the deduced sequence of this variant protein according to the present invention). TABLE-US-01224 TABLE 26 Amino acid mutations SNP position(s) on amino acid Alternative sequence amino acid(s) Previously known SNP? 4 A→P Yes 6 P→H Yes 13 R→H Yes 34 Q→No 38 G→R Yes 88 P→R Yes 124 R→Q Yes 127 S→No 145 F→S No 214 G→R No 214 G→No 262 Q→No 270 V→No 309 G→E Yes 370 Q→No The glycosylation sites of variant protein M78076_PEA.sub.--1_P25 (SEQ ID NO:768), as compared to the known protein Amyloid-like protein 1 precursor (SEQ ID NO:760), are described in Table 27 (given according to their position(s) on the amino acid sequence in the first column; the second column indicates whether the glycosylation site is present in the variant protein; and the last column indicates whether the position is different on the variant protein). TABLE-US-01225 TABLE 27 Glycosylation site(s) Position(s) on known amino Present in Position acid sequence variant protein? in variant protein? 337 yes 337 461 no 551 no Variant protein M78076_PEA.sub.--1_P25 (SEQ ID NO:768) is encoded by the following transcript(s): M78076_PEA.sub.--1_T28 (SEQ ID NO:724), for which the sequence(s) is/are given at the end of the application. The coding portion of transcript M78076_PEA.sub.--1_T28 (SEQ ID NO:724) is shown in bold; this coding portion starts at position 142 and ends at position 1656. The transcript also has the following SNPs as listed in Table 28 (given according to their position on the nucleotide sequence, with the alternative nucleic acid listed; the last column indicates whether the SNP is known or not; the presence of known SNPs in variant protein M78076_PEA.sub.--1_P25 (SEQ ID NO:768) sequence provides support for the deduced sequence of this variant protein according to the present invention). TABLE-US-01226 TABLE 28 Nucleic acid SNPs SNP position on nucleotide Alternative sequence nucleic acid Previously known SNP? 114 G→No 151 G→C Yes 158 C→A Yes 179 G→A Yes 219 A→G Yes 243 G→No 253 G→A Yes 315 A→G Yes 366 A→G Yes 404 C→G Yes 512 G→A Yes 522 C→No 522 C→T No 575 T→C No 781 G→No 781 G→A No 927 G→No 951 C→No 1067 G→A Yes 1077 G→A Yes 1251 G→No 1398 G→T Yes 1423 C→T Yes 1593 A→G No 1736 C→T Yes As noted above, cluster M78076 features 35 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster M78076_PEA.sub.--1_node.sub.--0 (SEQ ID NO:725) according to the present invention is supported by 47 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 29 below describes the starting and ending position of this segment on each transcript. TABLE-US-01227 TABLE 29 Segment location on transcripts Segment Segment Transcript name starting position ending position M78076_PEA__1_T2 (SEQ ID 1 160 NO: 716) M78076_PEA__1_T3 (SEQ ID 1 160 NO: 717) M78076_PEA__1_T5 (SEQ ID 1 160 NO: 718) M78076_PEA__1_T13 (SEQ ID 1 160 NO: 719) M78076_PEA__1_T15 (SEQ ID 1 160 NO: 720) M78076_PEA__1_T23 (SEQ ID 1 160 NO: 721) M78076_PEA__1_T26 (SEQ ID 1 160 NO: 722) M78076_PEA__1_T27 (SEQ ID 1 160 NO: 723) M78076_PEA__1_T28 (SEQ ID 1 160 NO: 724)

Segment cluster M78076_PEA.sub.--1_node.sub.--10 (SEQ ID NO:726) according to the present invention is supported by 70 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 30 below describes the starting and ending position of this segment on each transcript. TABLE-US-01228 TABLE 30 Segment location on transcripts Segment Segment Transcript name starting position ending position M78076_PEA__1_T2 (SEQ ID 433 565 NO: 716) M78076_PEA__1_T3 (SEQ ID 433 565 NO: 717) M78076_PEA__1_T5 (SEQ ID 433 565 NO: 718) M78076_PEA__1_T13 (SEQ ID 433 565 NO: 719) M78076_PEA__1_T15 (SEQ ID 433 565 NO: 720) M78076_PEA__1_T23 (SEQ ID 433 565 NO: 721) M78076_PEA__1_T26 (SEQ ID 433 565 NO: 722) M78076_PEA__1_T27 (SEQ ID 433 565 NO: 723) M78076_PEA__1_T28 (SEQ ID 433 565 NO: 724)

Segment cluster M78076_PEA.sub.--1_node.sub.--15 (SEQ ID NO:727) according to the present invention is supported by 74 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 31 below describes the starting and ending position of this segment on each transcript. TABLE-US-01229 TABLE 31 Segment location on transcripts Segment Segment Transcript name starting position ending position M78076_PEA__1_T2 (SEQ ID 679 812 NO: 716) M78076_PEA__1_T3 (SEQ ID 679 812 NO: 717) M78076_PEA__1_T5 (SEQ ID 679 812 NO: 718) M78076_PEA__1_T13 (SEQ ID 679 812 NO: 719) M78076_PEA__1_T15 (SEQ ID 679 812 NO: 720) M78076_PEA__1_T23 (SEQ ID 679 812 NO: 721) M78076_PEA__1_T26 (SEQ ID 679 812 NO: 722) M78076_PEA__1_T27 (SEQ ID 679 812 NO: 723) M78076_PEA__1_T28 (SEQ ID 679 812 NO: 724)

Segment cluster M78076_PEA.sub.--1_node.sub.--18 (SEQ ID NO:728) according to the present invention is supported by 95 libraries. The number of libraries was determined as previously described. This segment can be found in the following transcript(s): M78076_PEA.sub.--1_T2 SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 32 below describes the starting and ending position of this segment on each transcript. TABLE-US-01230 TABLE 32 Segment location on transcripts Segment Segment Transcript name starting position ending position M78076_PEA__1_T2 (SEQ ID 813 991 NO: 716) M78076_PEA__1_T3 (SEQ ID 813 991 NO: 717) M78076_PEA__1_T5 (SEQ ID 813 991 NO: 718) M78076_PEA__1_T13 (SEQ ID 813 991 NO: 719) M78076_PEA__1_T15 (SEQ ID 813 991 NO: 720) M78076_PEA__1_T23 (SEQ ID 813 991 NO: 721) M78076_PEA__1_T26 (SEQ ID 813 991 NO: 722) M78076_PEA__1_T27 (SEQ ID 813 991 NO: 723) M78076_PEA__1_T28 (SEQ ID 813 991 NO: 724)

Segment cluster M78076_PEA.sub.--1_node.sub.--20 (SEQ ID NO:729) according to the present invention is supported by 99 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 33 below describes the starting and ending position of this segment on each transcript. TABLE-US-01231 TABLE 33 Segment location on transcripts Segment Segment Transcript name starting position ending position M78076_PEA__1_T2 (SEQ ID 992 1122 NO: 716) M78076_PEA__1_T3 (SEQ ID 992 1122 NO: 717) M78076_PEA__1_T5 (SEQ ID 992 1122 NO: 718) M78076_PEA__1_T13 (SEQ ID 992 1122 NO: 719) M78076_PEA__1_T15 (SEQ ID 992 1122 NO: 720) M78076_PEA__1_T23 (SEQ ID 992 1122 NO: 721) M78076_PEA__1_T26 (SEQ ID. 992 1122 NO: 722) M78076_PEA__1_T27 (SEQ ID 992 1122 NO: 723) M78076_PEA__1_T28 (SEQ ID 992 1122 NO: 724)

Segment cluster M78076_PEA.sub.--1_node.sub.--24 (SEQ ID NO:730) according to the present invention is supported by 105 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 34 below describes the starting and ending position of this segment on each transcript. TABLE-US-01232 TABLE 34 Segment location on transcripts Segment Segment Transcript name starting position ending position M78076_PEA__1_T2 (SEQ ID 1198 1356 NO: 716) M78076_PEA__1_T3 (SEQ ID 1198 1356 NO: 717) M78076_PEA__1_T5 (SEQ ID 1198 1356 NO: 718) M78076_PEA__1_T13 (SEQ ID 1198 1356 NO: 719) M78076_PEA__1_T15 (SEQ ID 1198 1356 NO: 720) M78076_PEA__1_T26 (SEQ ID 1198 1356 NO: 722) M78076_PEA__1_T27 (SEQ ID 1198 1356 NO: 723) M78076_PEA__1_T28 (SEQ ID 1198 1356 NO: 724)

Segment cluster M78076_PEA.sub.--1_node.sub.--26 (SEQ ID NO:731) according to the present invention is supported by 99 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 35 below describes the starting and ending position of this segment on each transcript. TABLE-US-01233 TABLE 35 Segment location on transcripts Segment Segment Transcript name starting position ending position M78076_PEA__1_T2 (SEQ ID 1357 1485 NO: 716) M78076_PEA__1_T3 (SEQ ID 1357 1485 NO: 717) M78076_PEA__1_T5 (SEQ ID 1357 1485 NO: 718) M78076_PEA__1_T13 (SEQ ID 1357 1485 NO: 719) M78076_PEA__1_T15 (SEQ ID 1357 1485 NO: 720) M78076_PEA__1_T23 (SEQ ID 1198 1326 NO: 721) M78076_PEA__1_T26 (SEQ ID 1357 1485 NO: 722) M78076_PEA__1_T27 (SEQ ID 1357 1485 NO: 723) M78076_PEA__1_T28 (SEQ ID 1357 1485 NO: 724)

Segment cluster M78076_PEA.sub.--1_node.sub.--29 (SEQ ID NO:732) according to the present invention is supported by 2 libraries. The number of libraries was determined as previously described. This segment can be found in the following transcript(s): M78076_PEA.sub.--1_T27 (SEQ ID NO:723). Table 36 below describes the starting and ending position of this segment on each transcript. TABLE-US-01234 TABLE 36 Segment location on transcripts Segment Segment Transcript name starting position ending position M78076_PEA__1_T27 (SEQ ID 1490 3132 NO: 723)

Segment cluster M78076_PEA.sub.--1_node.sub.--32 (SEQ ID NO:733) according to the present invention is supported by 2 libraries. The number of libraries was determined as previously described. This segment can be found in the following transcript(s): M78076_PEA.sub.--1_T26 (SEQ ID NO:722) and M78076_PEA.sub.--1.sub.T27 (SEQ ID NO:723). Table 37 below describes the starting and ending position of this segment on each transcript. TABLE-US-01235 TABLE 37 Segment location on transcripts Segment Segment Transcript name starting position ending position M78076_PEA__1_T26 (SEQ ID 1586 2457 NO: 722) M78076_PEA__1_T27 (SEQ ID 3233 4104 NO: 723)

Segment cluster M78076_PEA.sub.--1_node.sub.--35 (SEQ ID NO:734) according to the present invention is supported by 4 libraries. The number of libraries was determined as previously described. This segment can be found in the following transcript(s): M78076_PEA.sub.--1_T2 (SEQ ID NO:716) and M78076_PEA.sub.--1_T5 (SEQ ID NO:718). Table 38 below describes the starting and ending position of this segment on each transcript. TABLE-US-01236 TABLE 38 Segment location on transcripts Segment Segment Transcript name starting position ending position M78076_PEA__1_T2 (SEQ ID 1694 1952 NO: 716) M78076_PEA__1_T5 (SEQ ID 1694 1952 NO: 718)

Segment cluster M78076_PEA.sub.--1_node.sub.--37 (SEQ ID NO:735) according to the present invention is supported by 11 libraries. The number of libraries was determined as previously described. This segment can be found in the following transcript(s): M78076_PEA.sub.--1_T3 (SEQ ID NO:717) and M78076_PEA.sub.--1_T5 (SEQ ID NO:718). Table 39 below describes the starting and ending position of this segment on each transcript. TABLE-US-01237 TABLE 39 Segment location on transcripts Segment Segment Transcript name starting position ending position M78076_PEA__1_T3 (SEQ ID 1718 2180 NO: 717) M78076_PEA__1_T5 (SEQ ID 1977 2439 NO: 718)

Segment cluster M78076_PEA.sub.--1_node.sub.--46 (SEQ ID NO:736) according to the present invention is supported by 3 libraries. The number of libraries was determined as previously described. This segment can be found in the following transcript(s): M78076_PEA.sub.--1_T15 (SEQ ID NO:720). Table 40 below describes the starting and ending position of this segment on each transcript. TABLE-US-01238 TABLE 40 Segment location on transcripts Segment Segment Transcript name starting position ending position M78076_PEA__1_T15 (SEQ ID 1852 1972 NO: 720)

Segment cluster M78076_PEA.sub.--1_node.sub.--47 (SEQ ID NO:737) according to the present invention is supported by 155 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718) M78076_PEA.sub.--1_T13 (SEQ ID NO:719), M78076_PEA.sub.--1_T15 (SEQ ID NO:720) and M78076_PEA.sub.--1_T23 (SEQ ID NO:721). Table 41 below describes the starting and ending position of this segment on each transcript. TABLE-US-01239 TABLE 41 Segment location on transcripts Segment Segment Transcript name starting position ending position M78076_PEA__1_T2 (SEQ ID 2111 2254 NO: 716) M78076_PEA__1_T3 (SEQ ID 2327 2470 NO: 717) M78076_PEA__1_T5 (SEQ ID 2586 2729 NO: 718) M78076_PEA__1_T13 (SEQ ID 1781 1924 NO: 719) M78076_PEA__1_T15 (SEQ ID 1973 2116 NO: 720) M78076_PEA__1_T23 (SEQ ID 1693 1836 NO: 721)

Segment cluster M78076_PEA.sub.--1_node.sub.--54 (SEQ ID NO:738) according to the present invention is supported by 133 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721) and M78076_PEA.sub.--1_T28 (SEQ ID NO:724). Table 42 below describes the starting and ending position of this segment on each transcript. TABLE-US-01240 TABLE 42 Segment location on transcripts Segment Segment Transcript name starting position ending position M78076_PEA__1_T2 (SEQ ID 2412 2715 NO: 716) M78076_PEA__1_T3 (SEQ ID 2628 2931 NO: 717) M78076_PEA__1_T5 (SEQ ID 2887 3190 NO: 718) M78076_PEA__1_T13 (SEQ ID 2082 2385 NO: 719) M78076_PEA__1_T15 (SEQ ID 2274 2577 NO: 720) M78076_PEA__1_T23 (SEQ ID 1994 2297 NO: 721) M78076_PEA__1_T28 (SEQ ID 1492 1795 NO: 724)

According to an optional embodiment of the present invention, short segments related to the above cluster are also provided. These segments are up to about 120 bp in length, and so are included in a separate description.

Segment cluster M78076_PEA.sub.--1_node.sub.--1 (SEQ ID NO:739) according to the present invention is supported by 47 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 43 below describes the starting and ending position of this segment on each transcript. TABLE-US-01241 TABLE 43 Segment location on transcripts Segment Segment Transcript name starting position ending position M78076_PEA__1_T2 (SEQ ID 161 204 NO: 716) M78076_PEA__1_T3 (SEQ ID 161 204 NO: 717) M78076_PEA__1_T5 (SEQ ID 161 204 NO: 718) M78076_PEA__1_T13 (SEQ ID 161 204 NO: 719) M78076_PEA__1_T15 (SEQ ID 161 204 NO: 720) M78076_PEA__1_T23 (SEQ ID 161 204 NO: 721) M78076_PEA__1_T26 (SEQ ID 161 204 NO: 722) M78076_PEA__1_T27 (SEQ ID 161 204 NO: 723) M78076_PEA__1_T28 (SEQ ID 161 204 NO: 724)

Segment cluster M78076_PEA.sub.--1_node.sub.--2 (SEQ ID NO:740) according to the present invention can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 44 below describes the starting and ending position of this segment on each transcript. TABLE-US-01242 TABLE 44 Segment location on transcripts Segment Segment Transcript name starting position ending position M78076_PEA__1_T2 (SEQ ID 205 224 NO: 716) M78076_PEA__1_T3 (SEQ ID 205 224 NO: 717) M78076_PEA__1_T5 (SEQ ID 205 224 NO: 718) M78076_PEA__1_T13 (SEQ ID 205 224 NO: 719) M78076_PEA__1_T15 (SEQ ID 205 224 NO: 720) M78076_PEA__1_T23 (SEQ ID 205 224 NO: 721) M78076_PEA__1_T26 (SEQ ID 205 224 NO: 722) M78076_PEA__1_T27 (SEQ ID 205 224 NO: 723) M78076_PEA__1_T28 (SEQ ID 205 224 NO: 724)

Segment cluster M78076_PEA.sub.--1_node.sub.--3 (SEQ ID NO:741) according to the present invention is supported by 52 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718) M78076_PEA.sub.--1_T13 (SEQ ID NO:719), M78076_PEA.sub.--1_T15 (SEQ ID NO:720), M78076PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 45 below describes the starting and ending position of this segment on each transcript. TABLE-US-01243 TABLE 45 Segment location on transcripts Segment Segment Transcript name starting position ending position M78076_PEA__1_T2 (SEQ ID 225 288 NO: 716) M78076_PEA__1_T3 (SEQ ID 225 288 NO: 717) M78076_PEA__1_T5 (SEQ ID 225 288 NO: 718) M78076_PEA__1_T13 (SEQ ID 225 288 NO: 719) M78076_PEA__1_T15 (SEQ ID 225 288 NO: 720) M78076_PEA__1_T23 (SEQ ID 225 288 NO: 721) M78076_PEA__1_T26 (SEQ ID 225 288 NO: 722) M78076_PEA__1_T27 (SEQ ID 225 288 NO: 723) M78076_PEA__1_T28 (SEQ ID 225 288 NO: 724)

Segment cluster M78076_PEA.sub.--1_node.sub.--6 (SEQ ID NO:742) according to the present invention is supported by 59 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 46 below describes the starting and ending position of this segment on each transcript. TABLE-US-01244 TABLE 46 Segment location on transcripts Segment Segment Transcript name starting position ending position M78076_PEA__1_T2 (SEQ ID 289 370 NO: 716) M78076_PEA__1_T3 (SEQ ID 289 370 NO: 717) M78076_PEA__1_T5 (SEQ ID 289 370 NO: 718) M78076_PEA__1_T13 (SEQ ID 289 370 NO: 719) M78076_PEA__1_T15 (SEQ ID 289 370 NO: 720) M78076_PEA__1_T23 (SEQ ID 289 370 NO: 721) M78076_PEA__1_T26 (SEQ ID 289 370 NO: 722) M78076_PEA__1_T27 (SEQ ID 289 370 NO: 723) M78076_PEA__1_T28 (SEQ ID 289 370 NO: 724)

Segment cluster M78076_PEA.sub.--1_node.sub.--7 (SEQ ID NO:743) according to the present invention is supported by 64 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 47 below describes the starting and ending position of this segment on each transcript. TABLE-US-01245 TABLE 47 Segment location on transcripts Segment Segment Transcript name starting position ending position M78076_PEA__1_T2 (SEQ ID 371 432 NO: 716) M78076_PEA__1_T3 (SEQ ID 371 432 NO: 717) M78076_PEA__1_T5 (SEQ ID 371 432 NO: 718) M78076_PEA__1_T13 (SEQ ID 371 432 NO: 719) M78076_PEA__1_T15 (SEQ ID 371 432 NO: 720) M78076_PEA__1_T23 (SEQ ID 371 432 NO: 721) M78076_PEA__1_T26 (SEQ ID 371 432 NO: 722) M78076_PEA__1_T27 (SEQ ID 371 432 NO: 723) M78076_PEA__1_T28 (SEQ ID 371 432 NO: 724)

Segment cluster M78076_PEA.sub.--1_node.sub.--12 (SEQ ID NO:744) according to the present invention is supported by 71 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 48 below describes the starting and ending position of this segment on each transcript. TABLE-US-01246 TABLE 48 Segment location on transcripts Segment Segment Transcript name starting position ending position M78076_PEA__1_T2 (SEQ ID 566 678 NO: 716) M78076_PEA__1_T3 (SEQ ID 566 678 NO: 717) M78076_PEA__1_T5 (SEQ ID 566 678 NO: 718) M78076_PEA__1_T13 (SEQ ID 566 678 NO: 719) M78076_PEA__1_T15 (SEQ ID 566 678 NO: 720) M78076_PEA__1_T23 (SEQ ID 566 678 NO: 721) M78076_PEA__1_T26 (SEQ ID 566 678 NO: 722) M78076_PEA__1_T27 (SEQ ID 566 678 NO: 723) M78076_PEA__1_T28 (SEQ ID 566 678 NO: 724)

Segment cluster M78076_PEA.sub.--1_node.sub.--22 (SEQ ID NO:745) according to the present invention is supported by 92 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722), M78076_PEA.sub.--1_T27 (SEQ ID NO:723) and M78076_PEA.sub.--1_T28 (SEQ ID NO:724). Table 49 below describes the starting and ending position of this segment on each transcript. TABLE-US-01247 TABLE 49 Segment location on transcripts Segment Segment Transcript name starting position ending position M78076_PEA__1_T2 (SEQ ID 1123 1197 NO: 716) M78076_PEA__1_T3 (SEQ ID 1123 1197 NO: 717) M78076_PEA__1_T5 (SEQ ID 1123 1197 NO: 718) M78076_PEA__1_T13 (SEQ ID 1123 1197 NO: 719) M78076_PEA__1_T15 (SEQ ID 1123 1197 NO: 720) M78076_PEA__1_T23 (SEQ ID 1123 1197 NO: 721) M78076_PEA__1_T26 (SEQ ID 1123 1197 NO: 722) M78076_PEA__1_T27 (SEQ ID 1123 1197 NO: 723) M78076_PEA__1_T28 (SEQ ID 1123 1197 NO: 724)

Segment cluster M78076_PEA.sub.--1_node.sub.--27 (SEQ ID NO:746) according to the present invention can be found in the following transcript(s): M78076_PEA.sub.--1_T27 (SEQ ID NO:723). Table 50 below describes the starting and ending position of this segment on each transcript. TABLE-US-01248 TABLE 50 Segment location on transcripts Segment Segment Transcript name starting position ending position M78076_PEA__1_T27 (SEQ ID 1486 1489 NO: 723)

Segment cluster M78076_PEA.sub.--1_node.sub.--30 (SEQ ID NO:747) according to the present invention is supported by 90 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722) and M78076_PEA.sub.--1_T27 (SEQ ID NO:723). Table 51 below describes the starting and ending position of this segment on each transcript. TABLE-US-01249 TABLE 51 Segment location on transcripts Segment Segment Transcript name starting position ending position M78076_PEA__1_T2 (SEQ ID 1486 1557 NO: 716) M78076_PEA__1_T3 (SEQ ID 1486 1557 NO: 717) M78076_PEA__1_T5 (SEQ ID 1486 1557 NO: 718) M78076_PEA__1_T13 (SEQ ID 1486 1557 NO: 719) M78076_PEA__1_T15 (SEQ ID 1486 1557 NO: 720) M78076_PEA__1_T23 (SEQ ID 1327 1398 NO: 721) M78076_PEA__1_T26 (SEQ ID 1486 1557 NO: 722) M78076_PEA__1_T27 (SEQ ID 3133 3204 NO: 723)

Segment cluster M78076_PEA.sub.--1_node.sub.--31 (SEQ ID NO:748) according to the present invention is supported by 89 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721), M78076_PEA.sub.--1_T26 (SEQ ID NO:722) and M78076_PEA.sub.--1_T27 (SEQ ID NO:723). Table 52 below describes the starting and ending position of this segment on each transcript. TABLE-US-01250 TABLE 52 Segment location on transcripts Segment Segment Transcript name starting position ending position M78076_PEA__1_T2 (SEQ ID 1558 1585 NO: 716) M78076_PEA__1_T3 (SEQ ID 1558 1585 NO: 717) M78076_PEA__1_T5 (SEQ ID 1558 1585 NO: 718) M78076_PEA__1_T13 (SEQ ID 1558 1585 NO: 719) M78076_PEA__1_T15 (SEQ ID 1558 1585 NO: 720) M78076_PEA__1_T23 (SEQ ID 1399 1426 NO: 721) M78076_PEA__1_T26 (SEQ ID 1558 1585 NO: 722) M78076_PEA__1_T27 (SEQ ID 3205 3232 NO: 723)

Segment cluster M78076_PEA.sub.--1_node.sub.--34 (SEQ ID NO:749) according to the present invention is supported by 103 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720) and M78076_PEA.sub.--1_T23 (SEQ ID NO:721). Table 53 below describes the starting and ending position of this segment on each transcript. TABLE-US-01251 TABLE 53 Segment location on transcripts Segment Segment Transcript name starting position ending position M78076_PEA__1_T2 (SEQ ID 1586 1693 NO: 716) M78076_PEA__1_T3 (SEQ ID 1586 1693 NO: 717) M78076_PEA__1_T5 (SEQ ID 1586 1693 NO: 718) M78076_PEA__1_T13 (SEQ ID 1586 1693 NO: 719) M78076_PEA__1_T15 (SEQ ID 1586 1693 NO: 720) M78076_PEA__1_T23 (SEQ ID 1427 1534 NO: 721)

Segment cluster M78076_PEA.sub.--1_node.sub.--36 (SEQ ID NO:750) according to the present invention can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720) and M78076_PEA.sub.--1_T23 (SEQ ID NO:721). Table 54 below describes the starting and ending position of this segment on each transcript. TABLE-US-01252 TABLE 54 Segment location on transcripts Segment Segment Transcript name starting position ending position M78076_PEA__1_T2 (SEQ ID 1953 1976 NO: 716) M78076_PEA__1_T3 (SEQ ID 1694 1717 NO: 717) M78076_PEA__1_T5 (SEQ ID 1953 1976 NO: 718) M78076_PEA__1_T13 (SEQ ID 1694 1717 NO: 719) M78076_PEA__1_T15 (SEQ ID 1694 1717 NO: 720) M78076_PEA__1_T23 (SEQ ID 1535 1558 NO: 721)

Segment cluster M78076_PEA.sub.--1_node.sub.--41 (SEQ ID NO:751) according to the present invention can be found in the following transcript(s): M78076_PEA.sub.--1_T3 (SEQ ID NO:717) and M78076_PEA.sub.--1_T5 (SEQ ID NO:718). Table 55 below describes the starting and ending position of this segment on each transcript. TABLE-US-01253 TABLE 55 Segment location on transcripts Segment Segment Transcript name starting position ending position M78076_PEA_1_T3 (SEQ ID 2181 2192 NO: 717) M78076_PEA_1_T5 (SEQ ID 2440 2451 NO: 718)

Segment cluster M78076_PEA.sub.--1_node.sub.--42 (SEQ ID NO:752) according to the present invention can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T15 (SEQ ID NO:720) and M78076_PEA.sub.--1_T23 (SEQ ID NO:721). Table 56 below describes the starting and ending position of this segment on each transcript. TABLE-US-01254 TABLE 56 Segment location on transcripts Segment Segment Transcript name starting position ending position M78076_PEA_1_T2 (SEQ ID 1977 1985 NO: 716) M78076_PEA_1_T3 (SEQ ID 2193 2201 NO: 717) M78076_PEA_1_T5 (SEQ ID 2452 2460 NO: 718) M78076_PEA_1_T15 (SEQ ID 1718 1726 NO: 720) M78076_PEA_1_T23 (SEQ ID 1559 1567 NO: 721)

Segment cluster M78076_PEA.sub.--1_node.sub.--43 (SEQ ID NO:753) according to the present invention is supported by 110 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T15 (SEQ ID NO:720) and M78076_PEA.sub.--1_T23 (SEQ ID NO:721). Table 57 below describes the starting and ending position of this segment on each transcript. TABLE-US-01255 TABLE 57 Segment location on transcripts Segment Segment Transcript name starting position ending position M78076_PEA_1_T2 (SEQ ID 1986 2047 NO: 716) M78076_PEA_1_T3 (SEQ ID 2202 2263 NO: 717) M78076_PEA_1_T5 (SEQ ID 2461 2522 NO: 718) M78076_PEA_1_T15 (SEQ ID 1727 1788 NO: 720) M78076_PEA_1_T23 (SEQ ID 1568 1629 NO: 721)

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to breast cancer), shown in Table 58. TABLE-US-01256 TABLE 58 Oligonucleotides related to this segment Oligonucleotide name Overexpressed in cancers Chip reference M78076_0_7_0 (SEQ ID breast malignant tumors BRS NO: 914)

Segment cluster M78076_PEA.sub.--1_node.sub.--45 (SEQ ID NO:754) according to the present invention is supported by 132 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720) and M78076_PEA.sub.--1_T23 (SEQ ID NO:721). Table 59 below describes the starting and ending position of this segment on each transcript. TABLE-US-01257 TABLE 59 Segment location on transcripts Segment Segment Transcript name starting position ending position M78076_PEA_1_T2 (SEQ ID 2048 2110 NO: 716) M78076_PEA_1_T3 (SEQ ID 2264 2326 NO: 717) M78076_PEA_1_T5 (SEQ ID 2523 2585 NO: 718) M78076_PEA_1_T13 (SEQ ID 1718 1780 NO: 719) M78076_PEA_1_T15 (SEQ ID 1789 1851 NO: 720) M78076_PEA_1_T23 (SEQ ID 1630 1692 NO: 721)

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to breast cancer), shown in Table 60. TABLE-US-01258 TABLE 60 Oligonucleotides related to this segment Oligonucleotide name Overexpressed in cancers Chip reference M78076_0_7_0 (SEQ ID breast malignant tumors BRS NO: 914)

Segment cluster M78076_PEA.sub.--1_node.sub.--49 (SEQ ID NO:755) according to the present invention is supported by 129 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720) and M78076_PEA.sub.--1_T23 (SEQ ID NO:721). Table 61 below describes the starting and ending position of this segment on each transcript. TABLE-US-01259 TABLE 61 Segment location on transcripts Segment Segment Transcript name starting position ending position M78076_PEA_1_T2 (SEQ ID 2255 2290 NO: 716) M78076_PEA_1_T3 (SEQ ID 2471 2506 NO: 717) M78076_PEA_1_T5 (SEQ ID 2730 2765 NO: 718) M78076_PEA_1_T13 (SEQ ID 1925 1960 NO: 719) M78076_PEA_1_T15 (SEQ ID 2117 2152 NO: 720) M78076_PEA_1_T23 (SEQ ID 1837 1872 NO: 721)

Segment cluster M78076_PEA.sub.--1_node.sub.--50 (SEQ ID NO:756) according to the present invention is supported by 125 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720) and M78076_PEA.sub.--1_T23 (SEQ ID NO:721). Table 62 below describes the starting and ending position of this segment on each transcript. TABLE-US-01260 TABLE 62 Segment location on transcripts Segment Segment Transcript name starting position ending position M78076_PEA_1_T2 (SEQ ID 2291 2329 NO: 716) M78076_PEA_1_T3 (SEQ ID 2507 2545 NO: 717) M78076_PEA_1_T5 (SEQ ID 2766 2804 NO: 718) M78076_PEA_1_T13 (SEQ ID 1961 1999 NO: 719) M78076_PEA_1_T15 (SEQ ID 2153 2191 NO: 720) M78076_PEA_1_T23 (SEQ ID 1873 1911 NO: 721)

Segment cluster M78076_PEA.sub.--1_node.sub.--51 (SEQ ID NO:757) according to the present invention is supported by 123 libraries. The number of libraries was determined as previously described. This segment can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720) and M78076_PEA.sub.--1_T23 (SEQ ID NO:721). Table 63 below describes the starting and ending position of this segment on each transcript. TABLE-US-01261 TABLE 63 Segment location on transcripts Segment Segment Transcript name starting position ending position M78076_PEA_1_T2 (SEQ ID 2330 2388 NO: 716) M78076_PEA_1_T3 (SEQ ID 2546 2604 NO: 717) M78076_PEA__1_T5 (SEQ ID 2805 2863 NO: 718) M78076_PEA__1_T13 (SEQ ID 2000 2058 NO: 719) M78076_PEA__1_T15 (SEQ ID 2192 2250 NO: 720) M78076_PEA__1_T23 (SEQ ID 1912 1970 NO: 721)

Segment cluster M78076_PEA.sub.--1_node.sub.--52 (SEQ ID NO:758) according to the present invention can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720) and M78076_PEA.sub.--1_T23 (SEQ ID NO:721). Table 64 below describes the starting and ending position of this segment on each transcript. TABLE-US-01262 TABLE 64 Segment location on transcripts Segment Segment Transcript name starting position ending position M78076_PEA__1_T2 (SEQ ID 2389 2405 NO: 716) M78076_PEA__1_T3 (SEQ ID 2605 2621 NO: 717) M78076_PEA__1_T5 (SEQ ID 2864 2880 NO: 718) M78076_PEA__1_T13 (SEQ ID 2059 2075 NO: 719) M78076_PEA__1_T15 (SEQ ID 2251 2267 NO: 720) M78076_PEA__1_T23 (SEQ ID 1971 1987 NO: 721)

Segment cluster M78076_PEA.sub.--1_node.sub.--53 (SEQ ID NO:759) according to the present invention can be found in the following transcript(s): M78076_PEA.sub.--1_T2 (SEQ ID NO:716), M78076_PEA.sub.--1_T3 (SEQ ID NO:717), M78076_PEA.sub.--1_T5 (SEQ ID NO:718), M78076_PEA.sub.--1_T13 (SEQ ID NO:719), M78076_PEA.sub.--1_T15 (SEQ ID NO:720), M78076_PEA.sub.--1_T23 (SEQ ID NO:721) and M78076_PEA.sub.--1_T28 (SEQ ID NO:724). Table 65 below describes the starting and ending position of this segment on each transcript. TABLE-US-01263 TABLE 65 Segment location on transcripts Segment Segment Transcript name starting position ending position M78076_PEA__1_T2 (SEQ ID 2406 2411 NO: 716) M78076_PEA__1_T3 (SEQ ID 2622 2627 NO: 717) M78076_PEA__1_T5 (SEQ ID 2881 2886 NO: 718) M78076_PEA__1_T13 (SEQ ID 2076 2081 NO: 719) M78076_PEA__1_T15 (SEQ ID 2268 2273 NO: 720) M78076_PEA__1_T23 (SEQ ID 1988 1993 NO: 721) M78076_PEA__1_T28 (SEQ ID 1486 1491 NO: 724)

Variant Protein Alignment to the Previously Known Protein:

Sequence name: APP1_HUMAN (SEQ ID NO:760)

Sequence Documentation:

Alignment of: M78076_PEA.sub.--1_P3 (SEQ ID NO:761).times.APP1_HUMAN (SEQ ID NO:760).

Alignment segment 1/1:

Quality: 5132.00 TABLE-US-01264 Quality: 5132.00 Escore: 0 Matching length: 517 Total length: 517 Matching Percent 100.00 Matching Percent Identity: 100.00 Similarity: Total Percent Similarity: 100.00 Total Percent Identity: 100.00 Gaps: 0

```
Alignment: TABLE-US-01265 1
MGPASPAARGLSRRPGQPPLPLLLPLLLLLLRAQPAIGSLAGGSPGAAEA      50
|||||||||||||||||||||||||||||||||||||||||||||||||      1
MGPASPAARGLSRRPGQPPLPLLLPLLLLLLRAQPAIGSLAGGSPGAAEA      50  51

PGSAQVAGLCGRLTLHRDLRTGRWEPDPQRSRRCLRDPQRVLEYCRQMYP     100
|||||||||||||||||||||||||||||||||||||||||||||||||     51
PGSAQVAGLCGRLTLHRDLRTGRWEPDPQRSRRCLRDPQRVLEYCRQMYP     100 101

ELQIARVEQATQAIPMERWCGGSRSGSCAHPHHQVVPFRCLPGEFVSEAL     150
|||||||||||||||||||||||||||||||||||||||||||||||||     101
ELQIARVEQATQAIPMERWCGGSRSGSCAHPHHQVVPFRCLPGEFVSEAL     150 151

LVPEGCRFLHQERMDQCESSTRRHQEAQEACSSQGLILHGSGMLLPCGSD     200
|||||||||||||||||||||||||||||||||||||||||||||||||     151
LVPEGCRFLHQERMDQCESSTRRHQEAQEACSSQGLILHGSGMLLPCGSD     200 201

RFRGVEYVCCPPPGTPDPSGTAVGDPSTRSWPPGSRVEGAEDEEEEESFP     250
|||||||||||||||||||||||||||||||||||||||||||||||||     201
RFRGVEYVCCPPPGTPDPSGTAVGDPSTRSWPPGSRVEGAEDEEEEESFP     250 251

QPVDDYFVEPPQAEEEEETVPPPSSHTLAVVGKVTPTPRPTDGVDIYFGM     300
|||||||||||||||||||||||||||||||||||||||||||||||||     251
QPVDDYFVEPPQAEEEEETVPPPSSHTLAVVGKVTPTPRPTDGVDIYFGM     300 301

PGEISEHEGFLRAKMDLEERRMRQINEVMREWAMADNQSKNLPKADRQAL     350
|||||||||||||||||||||||||||||||||||||||||||||||||     301
PGEISEHEGFLRAKMDLEERRMRQINEVMREWAMADNQSKNLPKADRQAL     350 351

NEHFQSILQTLEEQVSGERQRLVETHATRVIALINDQRRAALEGFLAALQ     400
|||||||||||||||||||||||||||||||||||||||||||||||||     351
NEHFQSILQTLEEQVSGERQRLVETHATRVIALINDQRRAALEGFLAALQ     400 401

ADPPQAERVLLALRRYLRAEQKEQRHTLRHYQHVAAVDPEKAQQMRFQVH     450
|||||||||||||||||||||||||||||||||||||||||||||||||     401
ADPPQAERVLLALRRYLRAEQKEQRHTLRHYQHVAAVDPEKAQQMRFQVH     450 451

THLQVIEERVNQSLGLLDQNPHLAQELRPQIQELLHSEHLGPSELEAPAP     500
|||||||||||||||||||||||||||||||||||||||||||||||||     451
THLQVIEERVNQSLGLLDQNPHLAQELRPQIQELLHSEHLGPSELEAPAP     500 501

GGSSEDKGGLQPPDSKD                                      517
|||||||||||||||||                                      501
GGSSEDKGGLQPPDSKD                                      517
```

Sequence name: APP1_HUMAN (SEQ ID NO:760)
Sequence Documentation:

Alignment of: M78076_PEA.sub.--1_P4 (SEQ ID NO:762).times.APP1_HUMAN (SEQ ID NO:760).

Alignment segment 1/1: TABLE-US-01266 Quality: 5223.00 Escore: 0 Matching length: 526 Total length: 526 Matching Percent 100.00 Matching Percent Identity: 100.00 Similarity: Total Percent Similarity: 100.00 Total Percent Identity: 100.00 Gaps: 0

```
Alignment: TABLE-US-01267 1
MGPASPAARGLSRRPGQPPLPLLLPLLLLLLRAQPAIGSLAGGSPGAAEA       50
||||||||||||||||||||||||||||||||||||||||||||||||||      1
MGPASPAARGLSRRPGQPPLPLLLPLLLLLLRAQPAIGSLAGGSPGAAEA       50  51

PGSAQVAGLCGRLTLHRDLRTGRWEPDPQRSRRCLRDPQRVLEYCRQMYP       100
||||||||||||||||||||||||||||||||||||||||||||||||||      51
PGSAQVAGLCGRLTLHRDLRTGRWEPDPQRSRRCLRDPQRVLEYCRQMYP       100 101

ELQIARVEQATQAIPMERWCGGSRSGSCAHPHHQVVPFRCLPGEFVSEAL       150
||||||||||||||||||||||||||||||||||||||||||||||||||      101
ELQIARVEQATQAIPMERWCGGSRSGSCAHPHHQVVPFRCLPGEFVSEAL       150 151

LVPEGCRFLHQERMDQCESSTRRHQEAQEACSSQGLILHGSGMLLPCGSD       200
||||||||||||||||||||||||||||||||||||||||||||||||||      151
LVPEGCRFLHQERMDQCESSTRRHQEAQEACSSQGLILHGSGMLLPCGSD       200 201

RFRGVEYVCCPPPGTPDPSGTAVGDPSTRSWPPGSRVEGAEDEEEEESFP       250
||||||||||||||||||||||||||||||||||||||||||||||||||      201
RFRGVEYVCCPPPGTPDPSGTAVGDPSTRSWPPGSRVEGAEDEEEEESFP       250 251

QPVDDYFVEPPQAEEEEETVPPPSSHTLAVVGKVTPTPRPTDGVDIYFGM       300
||||||||||||||||||||||||||||||||||||||||||||||||||      251
QPVDDYFVEPPQAEEEEETVPPPSSHTLAVVGKVTPTPRPTDGVDIYFGM       300 301

PGEISEHEGFLRAKMDLEERRMRQINEVMREWAMADNQSKNLPKADRQAL       350
||||||||||||||||||||||||||||||||||||||||||||||||||      301
PGEISEHEGFLRAKMDLEERRMRQINEVMREWAMADNQSKNLPKADRQAL       350 351

NEHFQSILQTLEEQVSGERQRLVETHATRVIALINDQRRAALEGFLAALQ       400
||||||||||||||||||||||||||||||||||||||||||||||||||      351
NEHFQSILQTLEEQVSGERQRLVETHATRVIALINDQRRAALEGFLAALQ       400 401

ADPPQAERVLLALRRYLRAEQKEQRHTLRHYQHVAAVDPEKAQQMRFQVH       450
||||||||||||||||||||||||||||||||||||||||||||||||||      401
ADPPQAERVLLALRRYLRAEQKEQRRTLRHYQHVAAVDPEKAQQMRFQVH       450 451

THLQVIEERVNQSLGLLDQNPHLAQELRPQIQELLHSEHLGPSELEAPAP       500
||||||||||||||||||||||||||||||||||||||||||||||||||      451
THLQVIEERVNQSLGLLDQNPHLAQELRPQIQELLHSEHLGPSELEAPAP       500 501

GGSSEDKGGLQPPDSKDDTPMTLPKG                              526
||||||||||||||||||||||||||                              501
GGSSEDKGGLQPPDSKDDTPMTLPKG                              526
```

Sequence name: APP1_HUMAN (SEQ ID NO:760)
Sequence Documentation:

Alignment of: M78076_PEA.sub.--1_P12 (SEQ ID NO:763).times.APP1_HUMAN (SEQ ID NO:760).

Alignment segment 1/1: TABLE-US-01268 Quality: 5223.00 Escore: 0 Matching length: 526 Total length: 526 Matching Percent 100.00 Matching Percent Identity: 100.00 Similarity: Total Percent Similarity: 100.00 Total Percent Identity: 100.00 Gaps: 0

```
Alignment: TABLE-US-01269 1
MGPASPAARGLSRRPGQPPLPLLLPLLLLLLRAQPAIGSLAGGSPGAAEA    50
||||||||||||||||||||||||||||||||||||||||||||||||||    1
MGPASPAARGLSRRPGQPPLPLLLPLLLLLLRAQPAIGSLAGGSPGAAEA    50  51

PGSAQVAGLCGRLTLHRDLRTGRWEPDPQRSRRCLRDPQRVLEYCRQMYP   100
||||||||||||||||||||||||||||||||||||||||||||||||||   51
PGSAQVAGLCGRLTLHRDLRTGRWEPDPQRSRRCLRDPQRVLEYCRQMYP   100 101

ELQIARVEQATQAIPMERWCGGSRSGSCAHPHHQVVPFRCLPGEFVSEAL   150
||||||||||||||||||||||||||||||||||||||||||||||||||   101
ELQIARVEQATQAIPMERWCGGSRSGSCAHPHHQVVPFRCLPGEFVSEAL   150 151

LVPEGCRFLHQERMDQCESSTRRHQEAQEACSSQGLILHGSGMLLPCGSD   200
||||||||||||||||||||||||||||||||||||||||||||||||||   151
LVPEGCRFLHQERMDQCESSTRRHQEAQEACSSQGLILHGSGMLLPCGSD   200 201

RFRGVEYVCCPPPGTPDPSGTAVGDPSTRSWPPGSRVEGAEDEEEEESFP   250
||||||||||||||||||||||||||||||||||||||||||||||||||   201
RFRGVEYVCCPPPGTPDPSGTAVGDPSTRSWPPGSRVEGAEDEEEEESFP   250 251

QPVDDYFVEPPQAEEEEETVPPPSSHTLAVVGKVTPTPRPTDGVDIYFGM   300
||||||||||||||||||||||||||||||||||||||||||||||||||   251
QPVDDYFVEPPQAEEEEETVPPPSSHTLAVVGKVTPTPRPTDGVDIYFGM   300 301

PGEISEHEGFLRAKMDLEERRMRQINEVMREWAMADNQSKNLPKADRQAL   350
||||||||||||||||||||||||||||||||||||||||||||||||||   301
PGEISEHEGFLRAKMDLEERRMRQINEVMREWAMADNQSKNLPKADRQAL   350 351

NEHFQSILQTLEEQVSGERQRLVETHATRVIALINDQRRAALEGFLAALQ   400
||||||||||||||||||||||||||||||||||||||||||||||||||   351
NEHFQSILQTLEEQVSGERQRLVETHATRVIALINDQRRAALEGFLAALQ   400 401

ADPPQAERVLLALRRYLRAEQKEQRHTLRHYQHVAAVDPEKAQQMRFQVH   450
||||||||||||||||||||||||||||||||||||||||||||||||||   401
ADPPQAERVLLALRRYLRAEQKEQRHTLRHYQHVAAVDPEKAQQMRFQVH   450 451

THLQVIEERVNQSLGLLDQNPHLAQELRPQIQELLHSEHLGPSELEAPAP   500
||||||||||||||||||||||||||||||||||||||||||||||||||   451
THLQVIEERVNQSLGLLDQNPHLAQELRPQIQELLHSEHLGPSELEAPAP   500 501

GGSSEDKGGLQPPDSKDDTPMTLPKG                          526
||||||||||||||||||||||||||                          501
GGSSEDKGGLQPPDSKDDTPMTLPKG                          526
```

Sequence name: APP1_HUMAN (SEQ ID NO:760)

Sequence Documentation:

Alignment of: M78076_PEA.sub.--1_P14 (SEQ ID NO:764).times.APP1_HUMAN (SEQ ID NO:760).

Alignment segment 1/1: TABLE-US-01270 Quality: 5672.00 Escore: 0 Matching length: 575 Total length: 575 Matching Percent 99.48 Matching Percent Identity: 99.48 Similarity: Total Percent Similarity: 99.48 Total Percent Identity: 99.48 Gaps: 0

```
Alignment: TABLE-US-01271 1
MGPASPAARGLSRRPGQPPLPLLLPLLLLLLRAQPAIGSLAGGSPGAAEA    50
||||||||||||||||||||||||||||||||||||||||||||||||||    1
MGPASPAARGLSRRPGQPPLPLLLPLLLLLLRAQPAIGSLAGGSPGAAEA    50  51

PGSAQVAGLCGRLTLHRDLRTGRWEPDPQRSRRCLRDPQRVLEYCRQMYP   100
||||||||||||||||||||||||||||||||||||||||||||||||||   51
PGSAQVAGLCGRLTLHRDLRTGRWEPDPQRSRRCLRDPQRVLEYCRQMYP   100 101

ELQIARVEQATQAIPMERWCGGSRSGSCAHPHHQVVPFRCLPGEFVSEAL   150
||||||||||||||||||||||||||||||||||||||||||||||||||   101
ELQIARVEQATQAIPMERWCGGSRSGSCAHPHHQVVPFRCLPGEFVSEAL   150 151

LVPEGCRFLHQERMDQCESSTRRHQEAQEACSSQGLILHGSGMLLPCGSD   200
||||||||||||||||||||||||||||||||||||||||||||||||||   151
LVPEGCRFLHQERMDQCESSTRRHQEAQEACSSQGLILHGSGMLLPCGSD   200 201

RFRGVEYVCCPPPGTPDPSGTAVGDPSTRSWPPGSRVEGAEDEEEEESFP   250
||||||||||||||||||||||||||||||||||||||||||||||||||   201
RFRGVEYVCCPPPGTPDPSGTAVGDPSTRSWPPGSRVEGAEDEEEEESFP   250 251

QPVDDYFVEPPQAEEEEETVPPPSSHTLAVVGKVTPTPRPTDGVDIYFGM   300
||||||||||||||||||||||||||||||||||||||||||||||||||   251
QPVDDYFVEPPQAEEEEETVPPPSSHTLAVVGKVTPTPRPTDGVDIYFGM   300 301
```

-continued
```
PGEISEHEGFLRAKMDLEERRMRQINEVMREWAMADNQSKNLPKADRQAL     350
||||||||||||||||||||||||||||||||||||||||||||||||||    301
PGEISEHEGFLRAKMDLEERRMRQINEVMREWAMADNQSKNLPKADRQAL     350 351

NEHFQSILQTLEEQVSGERQRLVETHATRVIALINDQRRAALEGFLAALQ     400
||||||||||||||||||||||||||||||||||||||||||||||||||    351
NEHFQSILQTLEEQVSGERQRLVETHATRVIALINDQRRAALEGFLAALQ     400 401

ADPPQAERVLLALRRYLRAEQKEQRHTLRHYQHVAAVDPEKAQQMRFQVH     450
||||||||||||||||||||||||||||||||||||||||||||||||||    401
ADPPQAERVLLALRRYLRAEQKEQRHTLRHYQHVAAVDPEKAQQMRFQVH     450 451

THLQVIEERVNQSLGLLDQNPHLAQELRPQIQELLHSEHLGPSELEAPAP     500
||||||||||||||||||||||||||||||||||||||||||||||||||    451
THLQVIEERVNQSLGLLDQNPHLAQELRPQIQELLHSEHLGPSELEAPAP     500 501

GGSSEDKGGLQPPDSKDDTPMTLPKGSTEQDAASPEKEKMNPLEQYERKV     550
||||||||||||||||||||||||||||||||||||||||||||||||||    501
GGSSEDKGGLQPPDSKDDTPMTLPKGSTEQDAASPEKEKMNPLEQYERKV     550 551

NASVPRGFPFHSSEIQRDELVRGGT                               575
|||||||||||||||||||   ||                                551
NASVPRGFPFHSSEIQRDELAPAGT                               575
```

Sequence name: APP1_HUMAN (SEQ ID NO:760)

Sequence Documentation:

Alignment of: M78076_PEA.sub.--1_P21 (SEQ ID NO:765).times.APP1_HUMAN (SEQ ID NO:760).

Alignment segment 1/1: TABLE-US-01272 Quality: 5822.00 Escore: 0 Matching length: 597 Total length: 650 Matching Percent 100.00 Matching Percent Identity: 100.00 Similarity: Total Percent Similarity: 91.85 Total Percent Identity: 91.85 Gaps: 1

```
Alignment: TABLE-US-01273 1
MGPASPAARGLSRRPGQPPLPLLLPLLLLLLRAQPAIGSLAGGSPGAAEA     50
|||||||||||||||||||||||||||||||||||||||||||||||||     1
MGPASPAARGLSRRPGQPPLPLLLPLLLLLLRAQPAIGSLAGGSPGAAEA     50 51

PGSAQVAGLCGRLTLHRDLRTGRWEPDPQRSRRCLRDPQRVLEYCRQMYP     100
|||||||||||||||||||||||||||||||||||||||||||||||||     51
PGSAQVAGLCGRLTLHRDLRTGRWEPDPQRSRRCLRDPQRVLEYCRQMYP     100 101

ELQIARVEQATQAIPMERWCGGSRSGSCAHPHHQVVPFRCLPGEFVSEAL     150
|||||||||||||||||||||||||||||||||||||||||||||||||     101
ELQIARVEQATQAIPMERWCGGSRSGSCAHPHHQVVPFRCLPGEFVSEAL     150 151

LVPEGCRFLHQERMDQCESSTRRHQEAQEACSSQGLILHGSGMLLPCGSD     200
|||||||||||||||||||||||||||||||||||||||||||||||||     151
LVPEGCRFLHQERMDQCESSTRRHQEAQEACSSQGLILHGSGMLLPCGSD     200 201

RFRGVEYVCCPPPGTPDPSGTAVGDPSTRSWPPGSRVEGAEDEEEEESFP     250
|||||||||||||||||||||||||||||||||||||||||||||||||     201
RFRGVEYVCCPPPGTPDPSGTAVGDPSTRSWPPGSRVEGAEDEEEEESFP     250 251

QPVDDYFVEPPQAEEEEETVPPPSSHTLAVVGKVTPTPRPTDGVDIYFGM     300
|||||||||||||||||||||||||||||||||||||||||||||||||     251
QPVDDYFVEPPQAEEEEETVPPPSSHTLAVVGKVTPTPRPTDGVDIYFGM     300 301

PGEISEHEGFLRAKMDLEERRMRQINEVMREWAMADNQSKNLPKADRQAL     350
|||||||||||||||||||||||||||||||||||||||||||||||||     301
PGEISEHEGFLRAKMDLEERRMRQINEVMREWAMADNQSKNLPKADRQAL     350 351

NE................................................    352
||                                                    351
NEHFQSILQTLEEQVSGERQRLVETHATRVIALINDQRRAALEGFLAALQ     400 353

.....AERVLLALRRYLRAEQKEQRHTLRHYQHVAAVDPEKAQQMRFQVH     397
     |||||||||||||||||||||||||||||||||||||||||||||     401
ADPPQAERVLLALRRYLRAEQKEQRHTLRHYQHVAAVDPEKAQQMRFQVH     450 398

THLQVIEERVNQSLGLLDQNPHLAQELRPQIQELLHSEHLGPSELEAPAP     447
|||||||||||||||||||||||||||||||||||||||||||||||||     451
THLQVIEERVNQSLGLLDQNPHLAQELRPQIQELLHSEHLGPSELEAPAP     500 448

GGSSEDKGGLQPPDSKDDTPMTLPKGSTEQDAASPEKEKMNPLEQYEPKV     497
||||||||||||||||||||||||||||||||||||||||||||||| ||    501
GGSSEDKGGLQPPDSKDDTPMTLPKGSTEQDAASPEKEKMNPLEQYERKV     550 498

NASVPRGFPFHSSEIQRDELAPAGTGVSREAVSGLLIMGAGGGSLIVLSM     547
```

```
                                                551
NASVPRGFPFHSSEIQRDELAPAGTGVSREAVSGLLIMGAGGGSLIVLSM  600 548

LLLRRKKPYGAISHGVVEVDPMLTLEEQQLRELQRHGYENPTYRFLEERP  597
                                                    601
LLLRRKKPYGAISHGVVEVDPMLTLEEQQLRELQRHGYENPTYRFLEERP  650
```

Sequence name: APP1_HUMAN (SEQ ID NO:760)
Sequence Documentation:
Alignment of: M78076_PEA.sub.--1_P24 (SEQ ID NO:766).times.APP1_HUMAN (SEQ ID NO:760).
Alignment segment 1/1: TABLE-US-01274 Quality: 4791.00 Escore: 0 Matching length: 485 Total length: 485 Matching Percent 99.79 Matching Percent Identity: 99.59 Similarity: Total Percent Similarity: 99.79 Total Percent Identity: 99.59 Gaps: 0

```
Alignment: TABLE-US-01275 1
MGPASPAARGLSRRPGQPPLPLLLPLLLLLLRAQPAIGSLAGGSPGAAEA   50
                                                    1
MGPASPAARGLSRRPGQPPLPLLLPLLLLLLRAQPAIGSLAGGSPGAAEA   50  51

PGSAQVAGLCGRLTLHRDLRTGRWEPDPQRSRRCLRDPQRVLEYCRQMYP  100
                                                    51
PGSAQVAGLCGRLTLHRDLRTGRWEPDPQRSRRCLRDPQRVLEYCRQMYP  100 101

ELQIARVEQATQAIPMERWCGGSRSGSCAHPHHQVVPFRCLPGEFVSEAL  150
                                                    101
ELQIARVEQATQAIPMERWCGGSRSGSCAHPHHQVVPFRCLPGEFVSEAL  150 151

LVPEGCRFLHQERMDQCESSTRRHQEAQEACSSQGLILHGSGMLLPCGSD  200
                                                    151
LVPEGCRFLHQERMDQCESSTRRHQEAQEACSSQGLILHGSGMLLPCGSD  200 201

RFRGVEYVCCPPPGTPDPSGTAVGDPSTRSWPPGSRVEGAEDEEEEESFP  250
                                                    201
RFRGVEYVCCPPPGTPDPSGTAVGDPSTRSWPPGSRVEGAEDEEEEESFP  250 251

QPVDDYFVEPPQAEEEEETVPPPSSHTLAVVGKVTPTPRPTDGVDIYFGM  300
                                                    251
QPVDDYFVEPPQAEEEEETVPPPSSHTLAVVGKVTPTPRPTDGVDIYFGM  300 301

PGETSEHEGFLRAKMDLEERRMRQINEVMREWAMADNQSKNLPKADRQAL  350
                                                    301
PGETSEHEGFLRAKMDLEERRMRQINEVMREWAMADNQSKNLPKADRQAL  350 351

NEHFQSILQTLEEQVSGERQRLVETHATRVIALINDQRRAALEGFLAALQ  400
                                                    351
NEHFQSILQTLEEQVSGERQRLVETHATRVIALINDQRRAALEGFLAALQ  400 401

ADPPQAERVLLALRRYLRAEQKEQRHTLRHYQHVAAVDPEKAQQMRFQVH  450
                                                    401
ADPPQAERVLLALRRYLRAEQKEQRHTLRHYQHVAAVDPEKAQQMRFQVH  450 451

THLQVIEERVNQSLGLLDQNPHLAQELRPQIRECL                 485
                                                    451
THLQVIEERVNQSLGLLDQNPHLAQELRPQIQELL                 485
```

Sequence name: APP1_HUMAN (SEQ ID NO:760)
Sequence Documentation:
Alignment of: M78076_PEA.sub.--1_P2 (SEQ ID NO:767).times.APP1_HUMAN (SEQ ID NO:760).
Alignment segment 1/1: TABLE-US-01276 Quality: 4474.00 Escore: 0 Matching length: 454 Total length: 454 Matching Percent 99.56 Matching Percent Identity: 99.34 Similarity: Total Percent Similarity: 99.56 Total Percent Identity: 99.34 Gaps: 0

```
Alignment: TABLE-US-01277 1
MGPASPAARGLSRRPGQPPLPLLLPLLLLLLRAQPAIGSLAGGSPGAAEA   50
                                                    1
MGPASPAARGLSRRPGQPPLPLLLPLLLLLLRAQPAIGSLAGGSPGAAEA   50  51

PGSAQVAGLCGRLTLHRDLRTGRWEPDPQRSRRCLRDPQRVLEYCRQMYP  100
```

-continued

```
                                                    51
PGSAQVAGLCGRLTLHRDLRTGRWEPDPQRSRRCLRDPQRVLEYCRQMYP  100 101

ELQIARVEQATQAIPMERWCGGSRSGSCAHPHHQVVPFRCLPGEFVSEAL  150
                                                    101
ELQIARVEQATQAIPMERWCGGSRSGSCAHPHHQVVPFRCLPGEFVSEAL  150 151

LVPEGCRFLHQERMDQCESSTRRHQEAQEACSSQGLILHGSGMLLPCGSD  200
                                                    151
LVPEGCRFLHQERMDQCESSTRRHQEAQEACSSQGLILHGSGMLLPCGSD  200 201

RFRGVEYVCCPPPGTPDPSGTAVGDPSTRSWPPGSRVEGAEDEEEEESFP  250
                                                    201
RFRGVEYVCCPPPGTPDPSGTAVGDPSTRSWPPGSRVEGAEDEEEEESFP  250 251

QPVDDYFVEPPQAEEEEETVPPPSSHTLAVVGKVTPTPRPTDGVDIYFGM  300
                                                    251
QPVDDYFVEPPQAEEEEETVPPPSSHTLAVVGKVTPTPRPTDGVDIYFGM  300 301

PGEISEHEGFLRAKMDLEERRMRQINEVMREWAMADNQSKNLPKADRQAL  350
                                                    301
PGEISEHEGFLRAKMDLEERRMRQINEVMREWAMADNQSKNLPKADRQAL  350 351

NEHFQSILQTLEEQVSGERQRLVETHATRVIALINDQRRAALEGFLAALQ  400
                                                    351
NEHFQSILQTLEEQVSGERQRLVETHATRVIALINDQRRAALEGFLAALQ  400 401

ADPPQAERVLLALRRYLRAEQKEQRHTLRHYQHVAAVDPEKAQQMRFQVL  450
                                                    401
ADPPQAERVLLALRRYLRAEQKEQRHTLRHYQHVAAVDPEKAQQMRFQVH  450 451

TSFQ                                                454
|:|                                                 451
THLQ                                                454
```

Sequence name: APP1_HUMAN (SEQ ID NO:760)

Sequence Documentation:

Alignment of: M78076_PEA.sub.--1_P25 (SEQ ID NO:768).times.APP1_HUMAN (SEQ ID NO:760).

Alignment segment 1/1: TABLE-US-01278 Quality: 4455.00 Escore: 0 Matching length: 448 Total length: 448 Matching Percent 100.00 Matching Percent Identity: 100.00 Similarity: Total Percent Similarity: 100.00 Total Percent Identity: 100.00 Gaps: 0

```
Alignment: TABLE-US-01279 1
MGPASPAARGLSRRPGQPPLPLLLPLLLLLLRAQPAIGSLAGGSPGAAEA  50
                                                    1
MGPASPAARGLSRRPGQPPLPLLLPLLLLLLRAQPAIGSLAGGSPGAAEA  50 51

PGSAQVAGLCGRLTLHRDLRTGRWEPDPQRSRRCLRDPQRVLEYCRQMYP  100
                                                    51
PGSAQVAGLCGRLTLHRDLRTGRWEPDPQRSRRCLRDPQRVLEYCRQMYP  100 101

ELQIARVEQATQAIPMERWCGGSRSGSCAHPHHQVVPFRCLPGEFVSEAL  150
                                                    101
ELQIARVEQATQAIPMERWCGGSRSGSCAHPHHQVVPFRCLPGEFVSEAL  150 151

LVPEGCRFLHQERMDQCESSTRRHQEAQEACSSQGLILHGSGMLLPCGSD  200
                                                    151
LVPEGCRFLHQERMDQCESSTRRHQEAQEACSSQGLILHGSGMLLPCGSD  200 201

RFRGVEYVCCPPPGTPDPSGTAVGDPSTRSWPPGSRVEGAEDEEEEESFP  250
                                                    201
RFRGVEYVCCPPPGTPDPSGTAVGDPSTRSWPPGSRVEGAEDEEEEESFP  250 251

QPVDDYFVEPPQAEEEEETVPPPSSHTLAVVGKVTPTPRPTDGVDTYFGM  300
                                                    251
QPVDDYFVEPPQAEEEEETVPPPSSHTLAVVGKVTPTPRPTDGVDTYFGM  300 301

PGEISEHEGFLRAKMDLEERRMRQINEVMREWAMADNQSKNLPKADRQAL  350
                                                    301
PGEISEHEGFLRAKMDLEERRMRQINEVMREWAMADNQSKNLPKADRQAL  350 351

NEHFQSILQTLEEQVSGERQRLVETHATRVIALINDQRRAALEGFLAALQ  400
                                                    351
NEHFQSILQTLEEQVSGERQRLVETHATRVIALINDQRRAALEGFLAALQ  400 401

ADPPQAERVLLALRRYLRAEQKEQRHTLRHYQHVAAVDPEKAQQMRFQ    448
                                                    401
ADPPQAERVLLALRRYLRAEQKEQRHTLRHYQHVAAVDPEKAQQMRFQ    448
```

Description for Cluster HSMUC1A

Cluster HSMUC1A features 14 transcript(s) and 22 segment(s) of interest, the names for which are given in Tables 1 and 2, respectively, the sequences themselves are given at the end of the application. The selected protein variants are given in table 3. TABLE-US-01280 TABLE 1 Transcripts of interest Transcript Name Sequence ID No. HSMUC1 A_PEA_1_T12 769 HSMUC1A_PEA_1_T26 770 HSMUC1A_PEA_1_T28 771 HSMUC1A_PEA_1_T29 772 HSMUC1A_PEA_1_T30 773 HSMUC1A_PEA_1_T31 774 HSMUC1A_PEA_1_T33 775 HSMUC1A_PEA_1_T34 776 HSMUC1A_PEA_1_T35 777 HSMUC1A_PEA_1_T36 778 HSMUC1A_PEA_1_T40 779 HSMUC1A_PEA_1_T42 780 HSMUC1A_PEA_1_T43 781 HSMUC1A_PEA_1_T47 782

TABLE-US-01281 TABLE 2 Segments of interest Segment Name Sequence ID No. HSMUC1A_PEA_1_node_0 783 HSMUC1A_PEA_1_node_14 784 HSMUC1A_PEA_1_node_24 785 HSMUC1A_PEA_1_node_29 786 HSMUC1A_PEA_1_node_35 787 HSMUC1A_PEA_1_node_38 788 HSMUC1A_PEA_1_node_3 789 HSMUC1A_PEA_1_node_4 790 HSMUC1A_PEA_1_node_5 791 HSMUC1A_PEA_1_node_6 792 HSMUC1A_PEA_1_node_7 793 HSMUC1A_PEA_1_node_17 794 HSMUC1A_PEA_1_node_18 795 HSMUC1A_PEA_1_node_20 796 HSMUC1A_PEA_1_node_21 797 HSMUC1A_PEA_1_node_23 798 HSMUC1A_PEA_1_node_26 799 HSMUC1A_PEA_1_node_27 800 HSMUC1A_PEA_1_node_31 801 HSMUC1A_PEA_1_node_34 802 HSMUC1A_PEA_1_node_36 803 HSMUC1A_PEA_1_node_37 804

TABLE-US-01282 TABLE 3 Proteins of interest Sequence ID Corresponding Protein Name No. Transcript(s) HSMUC1A_PEA_1_P25 806 HSMUC1A_PEA_1_T26 (SEQ ID NO:770) HSMUC1A_PEA_1_P29 807 HSMUC1A_PEA_1_T33 (SEQ ID NO:775) HSMUC1A_PEA_1_P30 808 HSMUC1A_PEA_1_T34 (SEQ ID NO:776) HSMUC1A_PEA_1_P32 809 HSMUC1A_PEA_1_T36 (SEQ ID NO:778) HSMUC1A_PEA_1_P36 810 HSMUC1A_PEA_1_T40 (SEQ ID NO:779) HSMUC1A_PEA_1_P39 811 HSMUC1A_PEA_1_T43 (SEQ ID NO:781) HSMUC1A_PEA_1_P45 812 HSMUC1A_PEA_1_T29 (SEQ ID NO:772) HSMUC1A_PEA_1_P49 813 HSMUC1A_PEA_1_T12 (SEQ ID NO:813) (SEQ ID NO:769) HSMUC1A_PEA_1_P52 814 HSMUC1A_PEA_1_T30 (SEQ ID NO:773) HSMUC1A_PEA_1_P53 815 HSMUC1A_PEA_1_T31 (SEQ ID NO:774) HSMUC1A_PEA_1_P56 816 HSMUC1A_PEA_1_T42 (SEQ ID NO:780) HSMUC1A_PEA_1_P58 817 HSMUC1A_PEA_1_T35 (SEQ ID NO:777) HSMUC1A_PEA_1_P59 818 HSMUC1A_PEA_1_T28 (SEQ ID NO:771) HSMUC1A_PEA_1_P63 819 HSMUC1A_PEA_1_T47 (SEQ ID NO:782)

These sequences are variants of the known protein Mucin 1 precursor (SwissProt accession identifier MUC1_HUMAN; known also according to the synonyms MUC-1; Polymorphic epithelial mucin; PEM; PEMT; Episialin; Tumor-associated mucin; Carcinoma-associated mucin; Tumor-associated epithelial membrane antigen; EMA; H23AG; Peanut-reactive urinary mucin; PUM; Breast carcinoma-associated antigen DF3; CD227 antigen), SEQ ID NO: 805, referred to herein as the previously known protein.

Protein Mucin 1 precursor (SEQ ID NO:805) is known or believed to have the following function(s): May play a role in adhesive functions and in cell-cell interactions, metastasis and signaling. May provide a protective layer on epithelial surfaces. Direct or indirect interaction with actin cytoskeleton. Isoform 7 behaves as a receptor and binds the secreted isoform 5. The binding induces the phosphorylation of the isoform 7, alters cellular morphology and initiates cell signaling. Can bind to GRB2 adapter protein. The sequence for protein Mucin 1 precursor (SEQ ID NO:805) is given at the end of the application, as "Mucin 1 precursor (SEQ ID NO:805) amino acid sequence". Known polymorphisms for this sequence are as shown in Table 4. TABLE-US-01283 TABLE 4 Amino acid mutations for Known Protein SNP position(s) on amino acid sequence Comment 1116 D→E: NO EFFECT ON BINDING OF ISOFORM 7.1116 D→A: DRASTICALLY REDUCED BINDING OF ISOFORM 7. 2 T→A 134 P→Q 154 P→Q 1021 S→T 1117 V→M 1193 Q→L 1231 K→T 1251 A→T Protein Mucin 1 precursor (SEQ ID NO:805) localization is believed to be Type I membrane protein. Two secreted forms (5 and 9) are also produced.

The previously known protein also has the following indication(s) and/or potential thereaputic use(s): Cancer, breast; Cancer, lung, non-small cell; Cancer, ovarian; Cancer, prostate. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: CD8 agonist; DNA antagonist; Immunostimulant; Interferon gamma agonist; MUC-1 inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer; Monoclonal antibody, murine; Immunotoxin; Immunostimulant; Immunoconjugate.

The following GO Annotation(s) apply to the previously known protein. The following annotation(s) were found: actin binding, which are annotation(s) related to Molecular Function; and cytoskeleton; integral plasma membrane protein, which are annotation(s) related to Cellular Component.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster HSMUC1A can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 43 refer to weighted expression of ESTs in each category, as "parts per million" (ratio of the expression of ESTs for a particular cluster to the expression of all ESTs in that category, according to parts per million).

Figure 43:
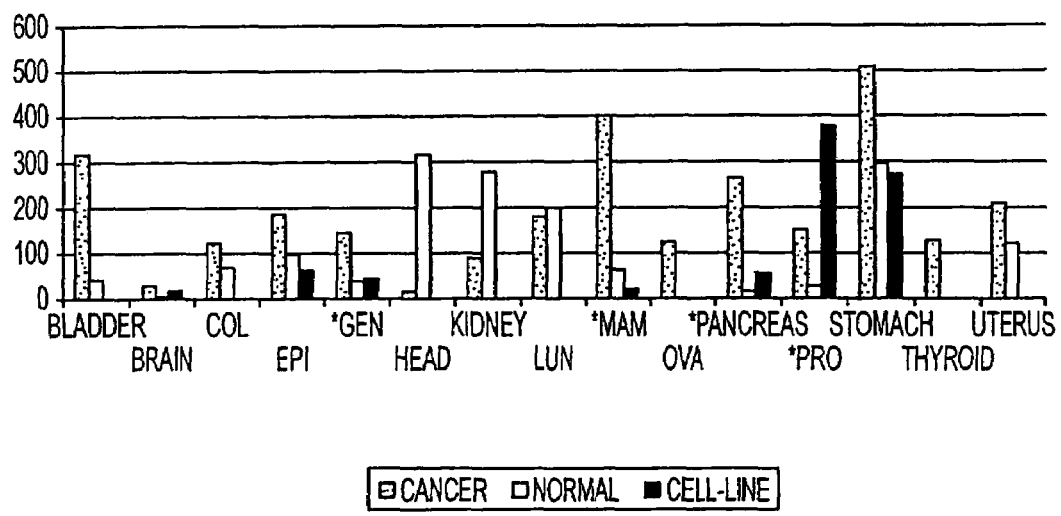
FIG. 43 is a histogram showing Cancer and cell-line vs. normal tissue expression for Cluster HSMUC 1A, demonstrating overexpression in a mixture of malignant tumors from different tissues, breast malignant tumors, pancreas carcinoma and prostate cancer.
Figure 44:
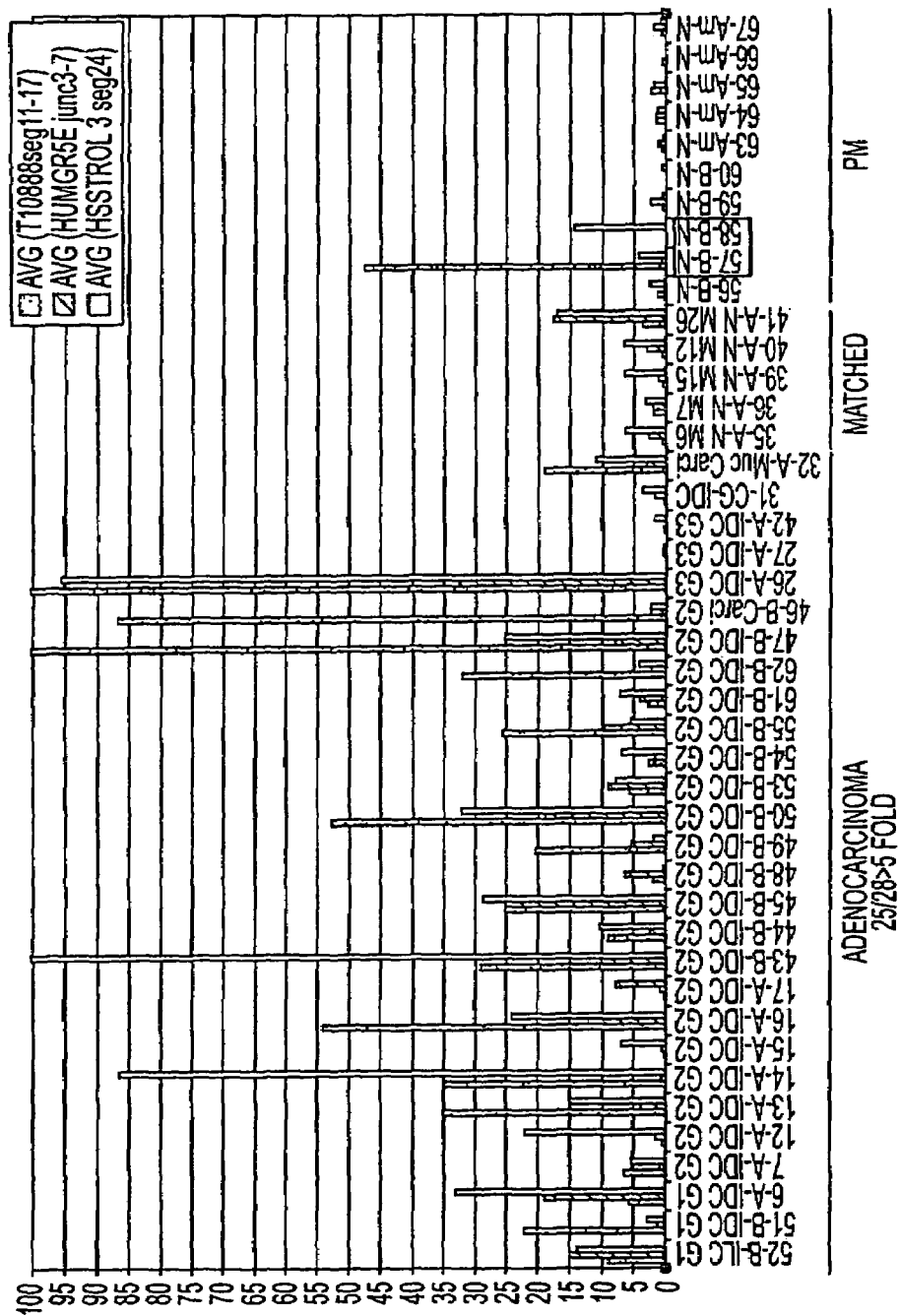
FIGS. 44-47 are histograms showing the combined expression of 8 sequences (T10888seg11-17, HUMGR5Ejunc3-7, HSSTROL3seg24, T94936 Seg 14, Z21368 seg39, Z21368junc17-21 T59832jun6-25-26 and M85491seg24 (SEQ ID NO:866)) in normal and cancerous breast tissues.
Figure 45:
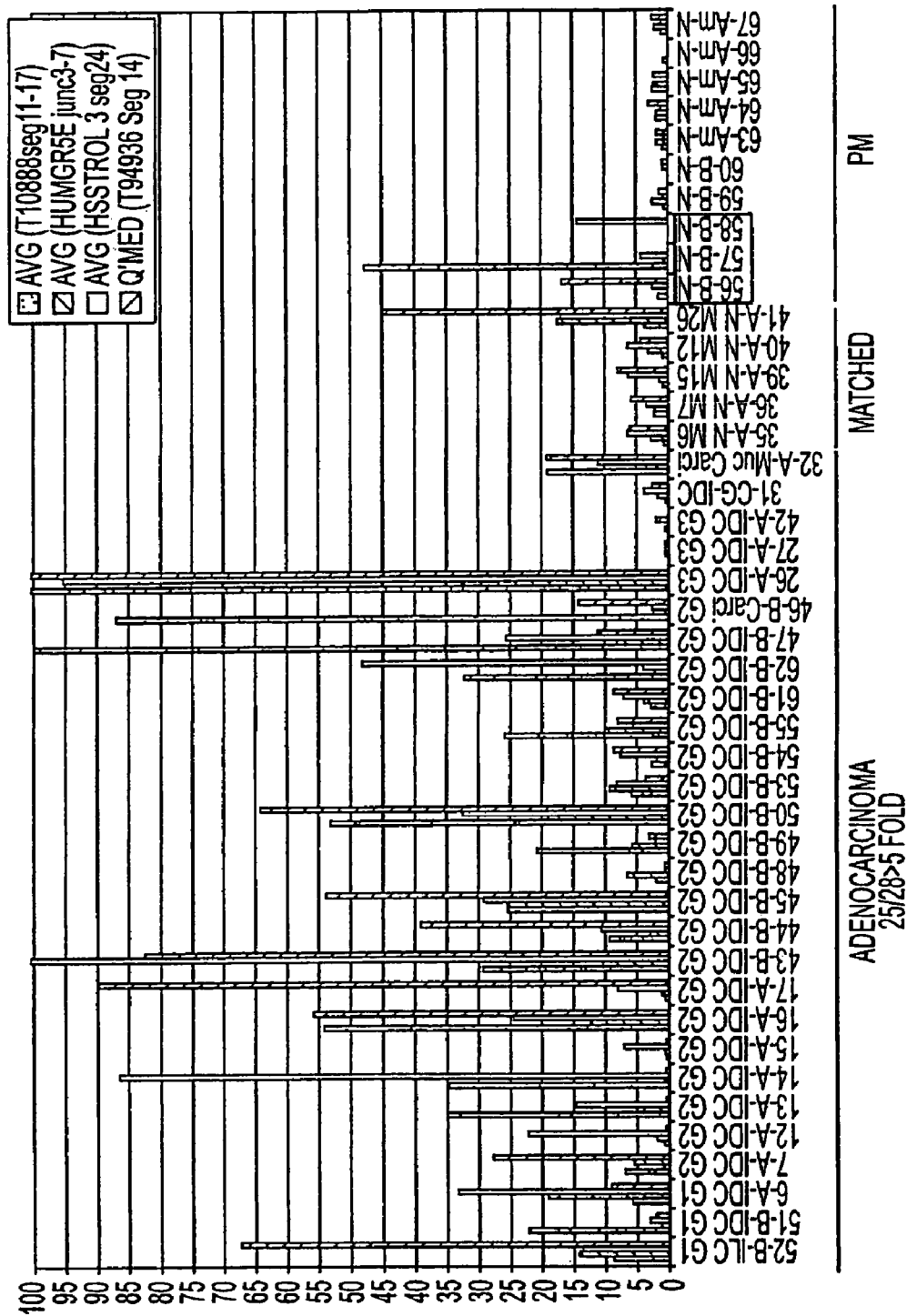
Figure 46:
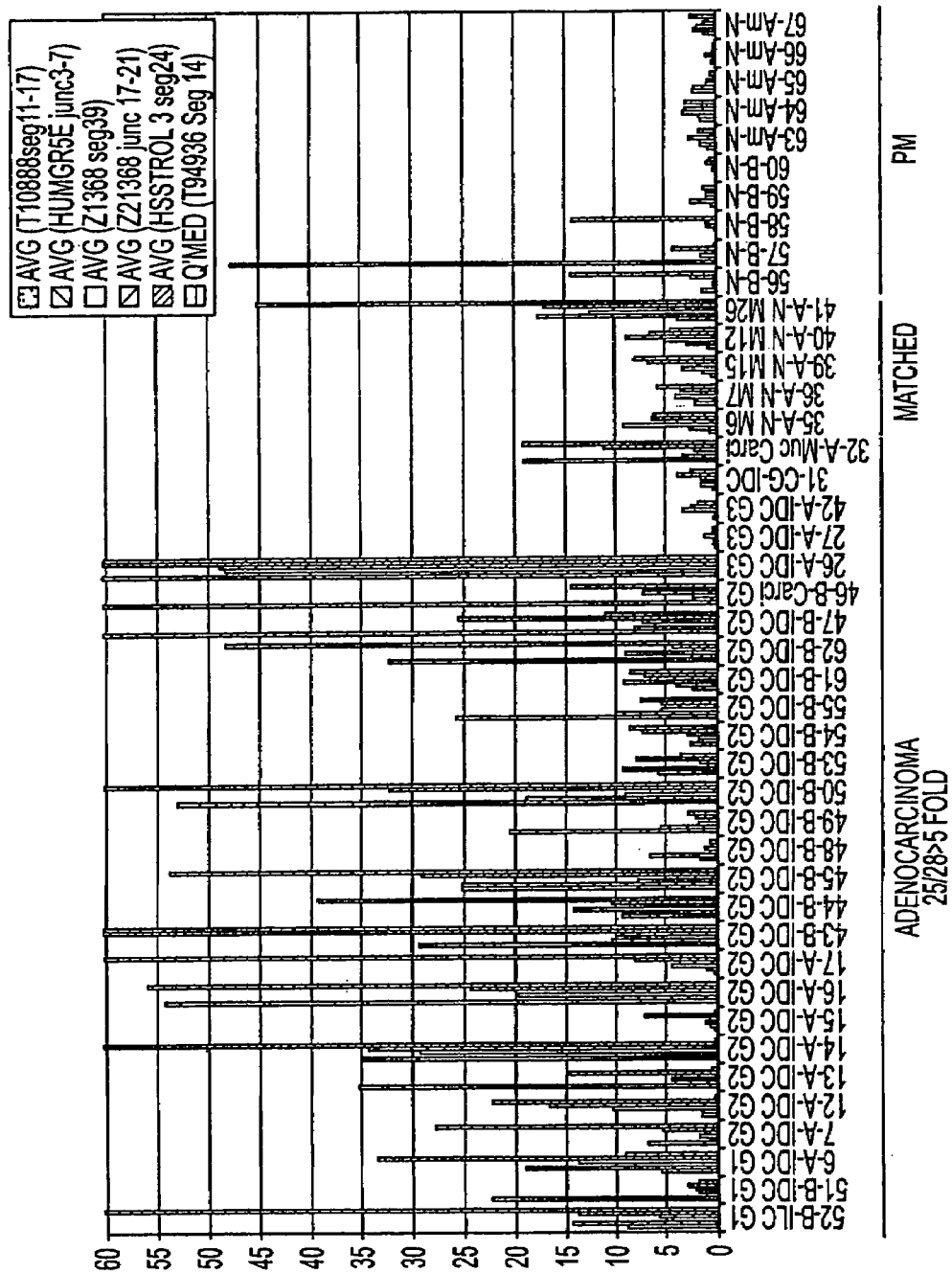
Figure 47:
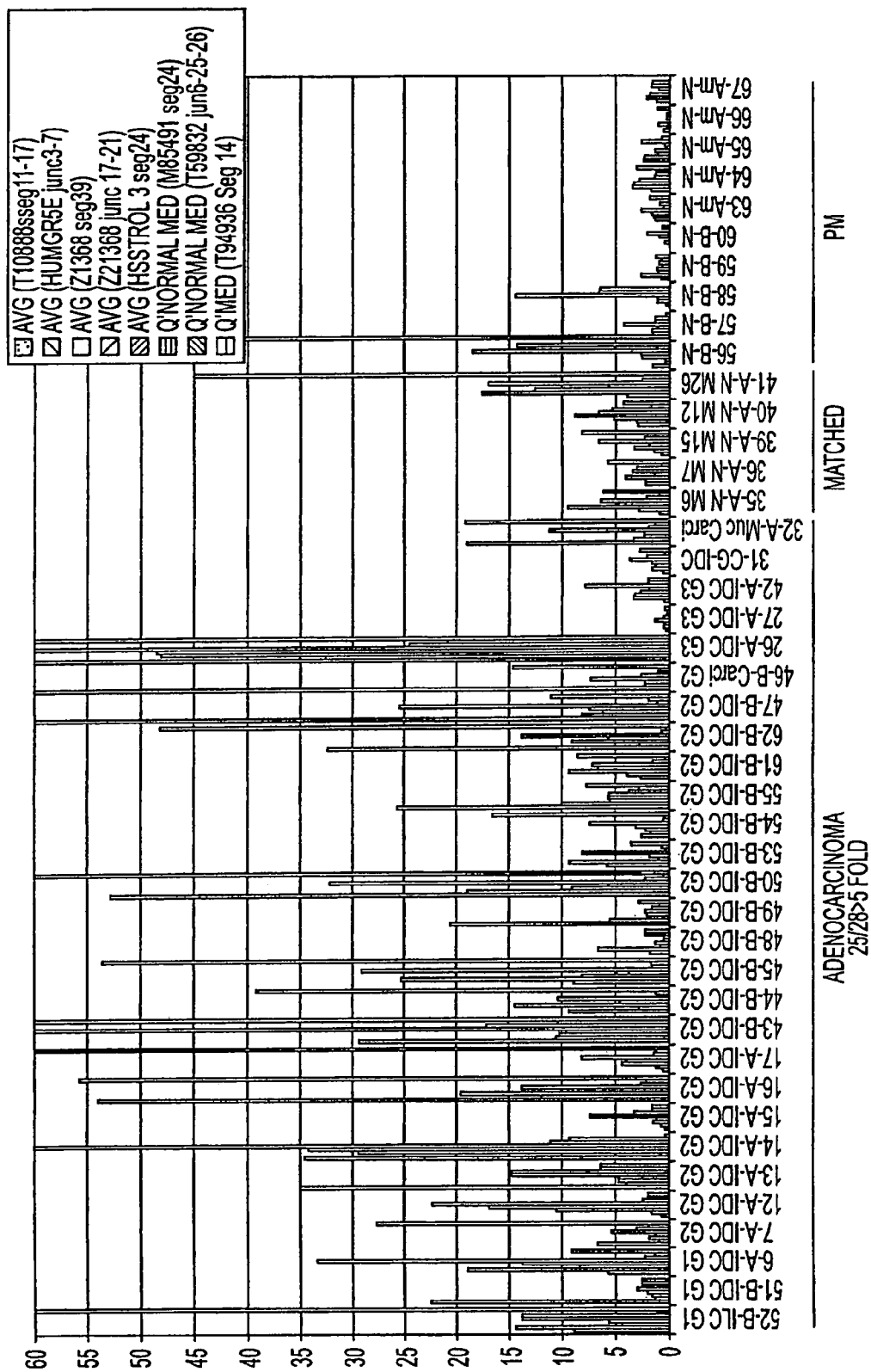

Overall, the following results were obtained as shown with regard to the histograms in FIG. 43 and Table 5. This cluster is overexpressed (at least at a minimum level) in the following pathological conditions: a mixture of malignant tumors from different tissues, breast malignant tumors, pancreas carcinoma and prostate cancer. TABLE-US-01284 TABLE 5 Normal tissue distribution Name of Tissue Number bladder 41 brain 2 colon 66 epithelial 96 general 36 head and neck 314 kidney 282 lung 200 breast 61 ovary 0 pancreas 12 prostate 24 stomach 296 Thyroid 0 uterus 122

TABLE-US-01285 TABLE 6 P values and ratios for expression in cancerous tissue Name of Tissue P1 P2 SP1 R3 SP2 R4 bladder 3.3e-01 4.5e-01 1.8e-02 2.4 8.9e-02 1.7 brain 3.0e-02 2.6e-02 1.2e-01 4.6 1.1e-01 3.9 colon 1.2e-01 2.4e-01 3.8e-01 1.6 5.9e-01 1.2 epithelial 5.4e-02 6.0e-01 7.3e-06 1.8 6.2e-02 1.1 general 6.5e-07 2.6e-03 4.0e-23 3.6 1.7e-12 2.3 head and neck 6.4e-01 7.2e-01 1 0.3 1 0.3 kidney 7.8e-01 8.1-01 1 0.3 1 0.2 lung 7.6e-01 7.9e-01 6.7e-01 0.8 1 0.4 breast 8.2e-02 1.3e-01 4.1e-03 3.6 7.7e-02 2.0 ovary 3.0e-02 4.3e-02 6.9e-02 4.4 1.6e-01 3.2 pancreas 7.2e-02 1.4e-01 9.6e-07 5.4 1.5e-05 4.5 prostate 7.0e-01 6.0e-01 1.5e-02 1.4 6.9e-04 3.2 stomach 3.1e-01 7.1e-01 1.5e-01 0.4 4.6e-01 0.8 Thyroid 2.9e-01 2.9e-01 4.4e-01 2.0 4.4e-01 2.0 uterus 2.4e-01 6.5e-01 1.6e-01 1.0 7.0e-01 0.6

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below (in relation to breast cancer), shown in Table 7. TABLE-US-01286 TABLE 7 Oligonucleotides related to this cluster Oligonucleotide Overexpressed in Chip name cancers reference HSMUC1A_0_0_11364 breast malignant BRS (SEQ ID NO:916) tumors As noted above, cluster HSMUC1A features 14 transcript(s), which were listed in Table 1 above. These transcript(s) encode for protein(s) which are variant(s) of protein Mucin 1 precursor (SEQ ID NO:805). A description of each variant protein according to the present invention is now provided.

Variant protein HSMUC1A_PEA.sub.--1_P25 (SEQ ID NO:806) according to the present invention has an amino acid sequence as given at the end of the application; it is encoded by transcript(s) HSMUC1A_PEA.sub.--1_T26 (SEQ ID NO:770). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein HSMUC1A_PEA.sub.--1_P25 (SEQ ID NO:806) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein HSMUC1A_PEA.sub.--1_P25 (SEQ ID NO:806) sequence provides support for the deduced sequence of this variant protein according to the present invention). TABLE-US-01287 TABLE 8 Amino acid mutations SNP position(s) on Alternative Previously amino acid sequence amino acid(s) known SNP? 90 S→N Yes 91 D→N No 157 Y→No 187 S→G No Variant protein HSMUC1A_PEA.sub.--1_P25 (SEQ ID NO:806) is encoded by the following transcript(s): HSMUC1A_PEA.sub.--1_T26 (SEQ ID NO:770), for which the sequence(s) is/are given at the end of the application. The coding portion of transcript HSMUC1A_PEA.sub.--1_T26 (SEQ ID NO:770) is shown in bold; this coding portion starts at position 507 and ends at position 1115. The transcript also has the following SNPs as listed in Table 9 (given according to their position on the nucleotide sequence, with the alternative nucleic acid listed; the last column indicates whether the SNP is known or not; the presence of known SNPs in variant protein HSMUC1A_PEA.sub.--1_P25 (SEQ ID NO:806) sequence provides support for the deduced sequence of this variant protein according to the present invention). TABLE-US-01288 TABLE 9 Nucleic acid SNPs SNP position on Alternative Previously nucleotide sequence nucleic acid known SNP? 572 A→G No 775 G→A Yes 777 G→A No 977 C→No 1065 A→G No 1073 C→T No 1079 C→T Yes 1124 C→T Yes 1177 C→T No 1197 C→T Yes 1303 G→No 1315 G→A Yes 1316 C→No 1316 C→T No 1405 A→T No Variant protein HSMUC1A_PEA.sub.--1_P29 (SEQ ID NO:807) according to the present invention has an amino acid sequence as given at the end of the application; it is encoded by transcript(s) HSMUC1A_PEA.sub.--1_T33 (SEQ ID NO:775). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA.sub.--1_P29 (SEQ ID NO:807) is encoded by the following transcript(s): HSMUC1A_PEA.sub.--1_T33 (SEQ ID NO:775), for which the sequence(s) is/are given at the end of the application. The coding portion of transcript HSMUC1A_PEA.sub.--1_T33 (SEQ ID NO:775) is shown in bold; this coding portion starts at position 507 and ends at position 953. The transcript also has the following SNPs as listed in Table 10 (given according to their position on the nucleotide sequence, with the alternative nucleic acid listed; the last column indicates whether the SNP is known or not; the presence of known SNPs in variant protein HSMUC1A_PEA.sub.--1_P29 (SEQ ID NO:807) sequence provides support for the deduced sequence of this variant protein according to the present invention). TABLE-US-01289 TABLE 10 Nucleic acid SNPs SNP position on Alternative Previously nucleotide sequence nucleic acid known SNP? 572 A→G No 964 C→No 1052 A→G No 1060 C→T No 1066 C→T Yes 1111 C→T Yes 1164 C→T No 1184 C→T Yes 1290 G→No 1302 G→A Yes 1303 C→No 1303 C→T No 1392 A→T No Variant protein HSMUC1A_PEA.sub.--1_P30 (SEQ ID NO:808) according to the present invention has an amino acid sequence as given at the end of the application; it is encoded by transcript(s) HSMUC1A_PEA.sub.--1_T34 (SEQ ID NO:776). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein HSMUC1A_PEA.sub.--1_P30 (SEQ ID NO:808) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein HSMUC1A_PEA.sub.--1_P30 (SEQ ID NO:808) sequence provides support for the deduced sequence of this variant protein according to the present invention). TABLE-US-01290 TABLE 11 Amino acid mutations SNP position(s) on Alternative Previously amino acid sequence amino acid(s) known SNP? 120 Y→No 150 S→G No Variant protein HSMUC1A_PEA.sub.--1_P30 (SEQ ID NO:808) is encoded by the following transcript(s): HSMUC1A_PEA.sub.--1_T34 (SEQ ID NO:776), for which the sequence(s) is/are given at the end of the application. The coding portion of transcript HSMUC1A_PEA.sub.--1_T34 (SEQ ID NO:776) is shown in bold; this coding portion starts at position 507 and ends at position 1004. The transcript also has the following SNPs as listed in Table 12 (given according to their position on the nucleotide sequence, with the alternative nucleic acid listed; the last column indicates whether the SNP is known or not; the presence of known SNPs in variant protein HSMUC1A_PEA.sub.--1_P30 (SEQ ID NO:808) sequence provides support for the deduced sequence of this variant protein according to the present invention). TABLE-US-01291 TABLE 12 Nucleic acid SNPs SNP position on Alternative Previously nucleotide sequence nucleic acid known SNP? 599 A→G No 866 C→No 954 A→G No 962 C→T No 968 C→T Yes 1013 C→T Yes 1066 C→T No 1086 C→T Yes 1192 G→No 1204 G→A Yes 1205 C→No 1205 C→T No 1294 A→T No Variant protein HSMUC1A_PEA.sub.--1_P32 (SEQ ID NO:809) according to the present invention has an amino acid sequence as given at the end of the application; it is encoded by transcript(s) HSMUC1A_PEA.sub.--1_T36 (SEQ ID NO:778). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein HSMUC1A_PEA.sub.--1_P32 (SEQ ID NO:809) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein HSMUC1A_PEA.sub.--1_P32 (SEQ ID NO:809) sequence provides support for the deduced sequence of this variant protein according to the present invention). TABLE-US-01292 TABLE 13 Amino acid mutations SNP position(s) on Alternative Previously amino acid sequence amino acid(s) known SNP? 111 Y→No 141 S→G No Variant protein HSMUC1A_PEA.sub.--1_P32 (SEQ ID NO:809) is encoded by the following transcript(s): HSMUC1A_PEA.sub.--1_T36 (SEQ ID NO:778), for which the sequence(s) is/are given at the end of the application. The coding portion of transcript HSMUC1A_PEA.sub.--1_T36 (SEQ ID NO:778) is shown in bold; this coding portion starts at position 507 and ends at position 977. The transcript also has the following SNPs as listed in Table 14 (given according to their position on the nucleotide sequence, with the alternative nucleic acid listed; the last column indicates whether the SNP is known or not; the presence of known SNPs in variant protein HSMUC1A_PEA.sub.--1_P32 (SEQ ID NO:809) sequence provides support for the deduced sequence of this variant protein according to the present invention). TABLE-US-01293 TABLE 14 Nucleic acid SNPs SNP position on Alternative Previously nucleotide sequence nucleic acid known SNP? 572 A→G No 839 C→No 927 A→G No 935 C→T No 941 C→T Yes 986 C→T Yes 1039 C→T No 1059 C→T Yes 1165 G→No 1177 G→A Yes 1178 C→No 1178 C→T No 1267 A→T No Variant protein HSMUC1A_PEA.sub.--1_P36 (SEQ ID NO:810) according to the present invention has an amino acid sequence as given at the end of the application; it is encoded by transcript(s) HSMUC1A_PEA.sub.--1_T40 (SEQ ID NO:779). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA.sub.--1_P36 (SEQ ID NO:810) also has the following non-silent SNPs (Single Nucleotide Polymorphisms) as listed in Table 15, (given according to their position(s) on the amino acid sequence, with the alternative amino acid(s) listed; the last column indicates whether the SNP is known or not; the presence of known SNPs in variant protein HSMUC1A_PEA.sub.--1_P36 (SEQ ID NO:810) sequence provides support for the deduced sequence of this variant protein according to the present invention). TABLE-US-01294 TABLE 15 Amino acid mutations SNP position(s) on Alternative Previously amino acid sequence amino acid(s) known SNP? 113 Y→No 143 S→G No Variant protein HSMUC1A_PEA.sub.--1_P36 (SEQ ID NO:810) is encoded by the following transcript(s): HSMUC1A_PEA.sub.--1_T40 (SEQ ID NO:779), for which the sequence(s) is/are given at the end of the application. The coding portion of transcript HSMUC1A_PEA.sub.--1_T40 (SEQ ID NO:779) is shown in bold; this coding portion starts at position 507 and ends at position 983. The transcript also has the following SNPs as listed in Table 16 (given according to their position on the nucleotide sequence, with the alternative nucleic acid listed; the last column indicates whether the SNP is known or not; the presence of known SNPs in variant protein HSMUC1A_PEA.sub.--1_P36 (SEQ ID NO:810) sequence provides support for the deduced sequence of this variant protein according to the present invention). TABLE-US-01295 TABLE 16 Nucleic acid SNPs SNP position on Alternative Previously nucleotide sequence nucleic acid known SNP? 599 A→G No 845 C→No 933 A→G No 941 C→T No 947 C→T Yes 992 C→T Yes 1045 C→T No 1065 C→T Yes 1171 G→No 1183 G→A Yes 1184 C→No 1184 C→T No 1273 A→T No Variant protein HSMUC1A_PEA.sub.--1_P39 (SEQ ID NO:811) according to the present invention has an amino acid sequence as given at the end of the application; it is encoded by transcript(s) HSMUC1A_PEA.sub.--1_T43 (SEQ ID NO:781). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA.sub.--1_P39 (SEQ ID NO:811) also has the following non-silent SNPs (Single Nucleotide Polymorphisms) as listed in Table 17, (given according to their position(s) on the amino acid sequence, with the alternative amino acid(s) listed; the last column indicates whether the SNP is known or not; the presence of known SNPs in variant protein HSMUC1A_PEA.sub.--1_P39 (SEQ ID NO:811) sequence provides support for the deduced sequence of this variant protein according to the present invention). TABLE-US-01296 TABLE 17 Amino acid mutations SNP position(s) on Alternative Previously amino acid sequence amino acid(s) known SNP? 90 Y→No 120 S→G No Variant protein HSMUC1A_PEA.sub.--1_P39 (SEQ ID NO:811) is encoded by the following transcript(s): HSMUC1A_PEA.sub.--1_T43 (SEQ ID NO:781), for which the sequence(s) is/are given at the end of the application. The coding portion of transcript HSMUC1A_PEA.sub.--1_T43 (SEQ ID NO:781) is shown in bold; this coding portion starts at position 507 and ends at position 914. The transcript also has the following SNPs as listed in Table 18 (given according to their position on the nucleotide sequence, with the alternative nucleic acid listed; the last column indicates whether the SNP is known or not; the presence of known SNPs in variant protein HSMUC1A_PEA.sub.--1_P39 (SEQ ID NO:811) sequence provides support for the deduced sequence of this variant protein according to the present invention). TABLE-US-01297 TABLE 18 Nucleic acid SNPs SNP position on Alternative Previously nucleotide sequence nucleic acid known SNP? 599 A→G No 776 C→No 864 A→G No 872 C→T No 878 C→T Yes 923 C→T Yes 976 C→T No 996 C→T Yes 1102 G→No 1114 G→A Yes 1115 C→No 1115 C→T No 1204 A→T No Variant protein HSMUC1A_PEA.sub.--1_P45 (SEQ ID NO:812) according to the present invention has an amino acid sequence as given at the end of the application; it is encoded by transcript(s) HSMUC1A_PEA.sub.--1_T29 (SEQ ID NO:772). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA.sub.--1_P45 (SEQ ID NO:812) is encoded by the following transcript(s): HSMUC1A_PEA.sub.--1_T29 (SEQ ID NO:772), for which the sequence(s) is/are given at the end of the application. The coding portion of transcript HSMUC1A_PEA.sub.--1_T29 (SEQ ID NO:772) is shown in bold; this coding portion starts at position 507 and ends at position 746. The transcript also has the following SNPs as listed in Table 19 (given according to their position on the nucleotide sequence, with the alternative nucleic acid listed; the last column indicates whether the SNP is known or not; the presence of known SNPs in variant protein HSMUC1A_PEA.sub.--1_P45 (SEQ ID NO:812) sequence provides support for the deduced sequence of this variant protein according to the present invention). TABLE-US-01298 TABLE 19 Nucleic acid SNPs SNP position on Alternative Previously nucleotide sequence nucleic acid known SNP? 599 A→G No 746 G→A Yes 748 G→A No 948 C→No 1036 A→G No 1044 C→T No 1050 C→T Yes 1095 C→T Yes 1148 C→T No 1168 C→T Yes 1274 G→No 1286 G→A Yes 1287 C→No 1287 C→T No 1376 A→T No Variant protein HSMUC1A_PEA.sub.--1_P49 (SEQ ID NO:813) according to the present invention has an amino acid sequence as given at the end of the application; it is encoded by transcript(s) HSMUC1A_PEA.sub.--1_T12 (SEQ ID NO:769). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA.sub.--1_P49 (SEQ ID NO:813) is encoded by the following transcript(s): HSMUC1A_PEA.sub.--1_T12 (SEQ ID NO:769), for which the sequence(s) is/are given at the end of the application. The coding portion of transcript HSMUC1A_PEA.sub.--1_T12 (SEQ ID NO:769) is shown in bold; this coding portion starts at position 507 and ends at position 884. The transcript also has the following SNPs as listed in Table 20 (given according to their position on the nucleotide sequence, with the alternative nucleic acid listed; the last column indicates whether the SNP is known or not; the presence of known SNPs in variant protein HSMUC1A_PEA.sub.--1_P49 (SEQ ID NO:813) sequence provides support for the deduced sequence of this variant protein according to the present invention). TABLE-US-01299 TABLE 20 Nucleic acid SNPs SNP position on Alternative Previously nucleotide sequence nucleic acid known SNP? 572 A→G No 704 G→A Yes 1012 G→A Yes 1088 G→A Yes 1090 G→A No 1290 C→No 1378 A→G No 1386 C→T No 1392 C→T Yes 1437 C→T Yes 1490 C→T No 1510 C→T Yes 1616 G→No 1628 G→A Yes 1629 C→No 1629 C→T No 1718 A→T No Variant protein HSMUC1A_PEA.sub.--1_P52 (SEQ ID NO:814) according to the present invention has an amino acid sequence as given at the end of the application; it is encoded by transcript(s) HSMUC1A_PEA.sub.--1_T30 (SEQ ID NO:773). The location of the variant protein was determined according to results from a number of different software programs and analyses, including analyses from SignalP and other specialized programs. The variant protein is believed to be located as follows with regard to the cell: secreted. The protein localization is believed to was secreted because both signal-peptide prediction programs predict that this protein has a signal peptide, and neither trans-membrane region prediction program predicts that this protein has a trans-membrane region.

Variant protein HSMUC1A_PEA.sub.--1_P52 (SEQ ID NO:814) is encoded by the following transcript(s): HSMUC1A_PEA.sub.--1_T30 (SEQ ID NO:773), for which the sequence(s) is/are given at the end of the application. The coding portion of transcript HSMUC1A_PEA.sub.--1_T30 (SEQ ID NO:773) is shown in bold; this coding portion starts at position 507 and ends at position 719. The transcript also has the following SNPs as listed in Table 21 (given according to their position on the nucleotide sequence, with the alternative nucleic acid listed; the last column indicates whether the SNP is known or not; the presence of known SNPs in variant protein HSMUC1A_PEA.sub.--1_P52 (SEQ ID NO:814) sequence provides support for the deduced sequence of this variant protein according to the present invention). TABLE-US-01300 TABLE 21 Nucleic acid SNPs SNP position on Alternative Previously nucleotide sequence nucleic acid known SNP? 572 A→G No 719 G→A Yes 721 G→A No 921 C→No 1009 A→G No 1017 C→T No 1023 C→T Yes 1068 C→T Yes 1121 C→T No 1141 C→T Yes 1247 G→No 1259 G→A Yes 1260 C→No 1260 C→T No 1349 A→T No Variant protein HSMUC1A_PEA.sub.--1_P53 (SEQ ID NO:815) according to the present invention has an amino acid sequence as given at the end of the application; it is encoded by transcript(s) HSMUC1A_PEA.sub.--1_T31 (SEQ ID NO:774). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA.sub.--1_P53 (SEQ ID NO:815) is encoded by the following transcript(s): HSMUC1A_PEA.sub.--1_T31 (SEQ ID NO:774), for which the sequence(s) is/are given at the end of the application. The coding portion of transcript HSMUC1A_PEA.sub.--1_T31 (SEQ ID NO:774) is shown in bold; this coding portion starts at position 507 and ends at position 665. The transcript also has the following SNPs as listed in Table 22 (given according to their position on the nucleotide sequence, with the alternative nucleic acid listed; the last column indicates whether the SNP is known or not; the presence of known SNPs in variant protein HSMUC1A_PEA.sub.--1_P53 (SEQ ID NO:815) sequence provides support for the deduced sequence of this variant protein according to the present invention). TABLE-US-01301 TABLE 22 Nucleic acid SNPs SNP position on Alternative Previously nucleotide sequence nucleic acid known SNP? 572 A→G No 669 G→A Yes 671 G →A No 871 C→No 959 A→G No 967 C→T No 973 C→T Yes 1018 C→T Yes 1071 C→T No 1091 C→T Yes 1197 G→No 1209 G→A Yes 1210 C→No 1210 C→T No 1299 A→T No Variant protein HSMUC1A_PEA.sub.--1_P56 (SEQ ID NO:816) according to the present invention has an amino acid sequence as given at the end of the application; it is encoded by transcript(s) HSMUC1A_PEA.sub.--1_T42 (SEQ ID NO:780). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA.sub.--1_P56 (SEQ ID NO:816) also has the following non-silent SNPs (Single Nucleotide Polymorphisms) as listed in Table 23, (given according to their position(s) on the amino acid sequence, with the alternative amino acid(s) listed; the last column indicates whether the SNP is known or not; the presence of known SNPs in variant protein HSMUC1A_PEA.sub.--1_P56 (SEQ ID NO:816) sequence provides support for the deduced sequence of this variant protein according to the present invention). TABLE-US-01302 TABLE 23 Amino acid mutations SNP position(s) on Alternative Previously amino acid sequence amino acid(s) known SNP? 117 P→No Variant protein HSMUC1A_PEA.sub.--1_P56 (SEQ ID NO:816) is encoded by the following transcript(s): HSMUC1A_PEA.sub.--1_T42 (SEQ ID NO:780), for which the sequence(s) is/are given at the end of the application. The coding portion of transcript HSMUC1A_PEA.sub.--1_T42 (SEQ ID NO:780) is shown in bold; this coding portion starts at position 507 and ends at position 890. The transcript also has the following SNPs as listed in Table 24 (given according to their position on the nucleotide sequence, with the alternative nucleic acid listed; the last column indicates whether the SNP is known or not; the presence of known SNPs in variant protein HSMUC1A_PEA.sub.--1_P56 (SEQ ID NO:816) sequence provides support for the deduced sequence of this variant protein according to the present invention). TABLE-US-01303 TABLE 24 Nucleic acid SNPs SNP position on Alternative Previously nucleotide sequence nucleic acid known SNP? 572 A→G No 855 C→No 943 A→G No 951 C→T No 957 C→T Yes 1002 C→T Yes 1055 C→T No 1075 C→T Yes 1181 G→No 1193 G→A Yes 1194 C→No 1194 C→T No 1283 A→T No Variant protein HSMUC1A_PEA.sub.--1_P58 (SEQ ID NO:817) according to the present invention has an amino acid sequence as given at the end of the application; it is encoded by transcript(s) HSMUC1A_PEA.sub.--1_T35 (SEQ ID NO:777). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA.sub.--1_P58 (SEQ ID NO:817) also has the following non-silent SNPs (Single Nucleotide Polymorphisms) as listed in Table 25, (given according to their position(s) on the amino acid sequence, with the alternative amino acid(s) listed; the last column indicates whether the SNP is known or not; the presence of known SNPs in variant protein HSMUC1A_PEA.sub.--1_P58 (SEQ ID NO:817) sequence provides support for the deduced sequence of this variant protein according to the present invention). TABLE-US-01304 TABLE 25 Amino acid mutations SNP position(s) on Alternative Previously amino acid sequence amino acid(s) known SNP? 147 P→No Variant protein HSMUC1A_PEA.sub.--1_P58 (SEQ ID NO:817) is encoded by the following transcript(s): HSMUC1A_PEA.sub.--1_T35 (SEQ ID NO:777), for which the sequence(s) is/are given at the end of the application. The coding portion of transcript HSMUC1A_PEA.sub.--1_T35 (SEQ ID NO:777) is shown in bold; this coding portion starts at position 507 and ends at position 980. The transcript also has the following SNPs as listed in Table 26 (given according to their position on the nucleotide sequence, with the alternative nucleic acid listed; the last column indicates whether the SNP is known or not; the presence of known SNPs in variant protein HSMUC1A_PEA.sub.--1_P58 (SEQ ID NO:817) sequence provides support for the deduced sequence of this variant protein according to the present invention). TABLE-US-01305 TABLE 26 Nucleic acid SNPs SNP position on Alternative Previously nucleotide sequence nucleic acid known SNP? 572 A→G No 945 C→No 1033 A→G No 1041 C→T No 1047 C→T Yes 1092 C→T Yes 1145 C→T No 1165 C→T Yes 1271 G→No 1283 G→A Yes 1284 C→No 1284 C→T No 1373 A→T No Variant protein HSMUC1A_PEA.sub.--1_P59 (SEQ ID NO:818) according to the present invention has an amino acid sequence as given at the end of the application; it is encoded by transcript(s) HSMUC1A_PEA.sub.--1_T28 (SEQ ID NO:771). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA.sub.--1_P59 (SEQ ID NO:818) is encoded by the following transcript(s): HSMUC1A_PEA.sub.--1_T28 (SEQ ID NO:771), for which the sequence(s) is/are given at the end of the application. The coding portion of transcript HSMUC1A_PEA.sub.--1_T28 (SEQ ID NO:771) is shown in bold; this coding portion starts at position 507 and ends at position 794. The transcript also has the following SNPs as listed in Table 27 (given according to their position on the nucleotide sequence, with the alternative nucleic acid listed; the last column indicates whether the SNP is known or not; the presence of known SNPs in variant protein HSMUC1A_PEA.sub.--1_P59 (SEQ ID NO:818) sequence provides support for the deduced sequence of this variant protein according to the present invention). TABLE-US-01306 TABLE 27 Nucleic acid SNPs SNP position on Alternative Previously nucleotide sequence nucleic acid known SNP? 572 A→G No 794 G→A Yes 796 G→A No 996 C→No 1084 A→G No 1092 C→T No 1098 C→T Yes 1143 C→T Yes 1196 C→T No 1216 C→T Yes 1322 G→No 1334 G→A Yes 1335 C→No 1335 C→T No 1424 A→T No Variant protein HSMUC1A_PEA.sub.--1_P63 (SEQ ID NO:819) according to the present invention has an amino acid sequence as given at the end of the application; it is encoded by transcript(s) HSMUC1A_PEA.sub.--1_T47 (SEQ ID NO:782). An alignment is given to the known protein (Mucin 1 precursor (SEQ ID NO:805) ) at the end of the application. One or more alignments to one or more previously published protein sequences are given at the end of the application. A brief description of the relationship of the variant protein according to the present invention to each such aligned protein is as follows:

Comparison report between HSMUC1A_PEA.sub.--1_P63 (SEQ ID NO:819) and MUC1_HUMAN (SEQ ID NO:805):

1. An isolated chimeric polypeptide encoding for HSMUC1A_PEA.sub.--1_P63 (SEQ ID NO:819), comprising a first amino acid sequence being at least 90% homologous to MTPGTQSPFFLLLLLTVLTVVTGSGHAS-STPGGEKETSATQRSSV corresponding to amino acids 1-45 of MUC1_HUMAN (SEQ ID NO:805), which also corresponds to amino acids 1-45 of HSMUC1A_PEA.sub.--1_P63 (SEQ ID NO:819), and a second amino acid sequence being at least 70%, optionally at least 80%, preferably at least 85%, more preferably at least 90% and most preferably at least 95% homologous to a polypeptide having the sequence EEEVSADQVSVGASGVLGSFKEARNAPS-FLSWSFSMGPSK (SEQ ID NO:946) corresponding to amino acids 46-85 of HSMUC1A_PEA.sub.--1_P63 (SEQ ID NO:819), wherein said first amino acid sequence and second amino acid sequence are contiguous and in a sequential order.

2. An isolated polypeptide encoding for a tail of HSMUC1A_PEA.sub.--1_P63 (SEQ ID NO:819), comprising a polypeptide being at least 70%, optionally at least about 80%, preferably at least about 85%, more preferably at least about 90% and most preferably at least about 95% homologous to the sequence TABLE-US-01307 EEEVSADQVSV-GASGVLGSFKEARNAPSFLSWSFSMGPSK (SEQ ID NO:946) in HSMUC1A_PEA__1_P63. (SEQ ID NO:819)

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein HSMUC1A_PEA.sub.--1_P63 (SEQ ID NO:819), as compared to the known protein Mucin 1 precursor (SEQ ID NO:805), are described in Table 28 (given according to their position(s) on the amino acid sequence in the first column; the second column indicates whether the glycosylation site is present in the variant protein; and the last column indicates whether the position is different on the variant protein). TABLE-US-01308 TABLE 28 Glycosylation site(s) Position(s) on known Present in amino acid sequence variant protein? 1055 no 957 no 975 no 1133 no 1029 no Variant protein HSMUC1A_PEA.sub.--1_P63 (SEQ ID NO:819) is encoded by the following transcript(s): HSMUC1A_PEA.sub.--1_T47 (SEQ ID NO:782), for which the sequence(s) is/are given at the end of the application. The coding portion of transcript HSMUC1A_PEA.sub.--1_T47 (SEQ ID NO:782) is shown in bold; this coding portion starts at position 507 and ends at position 761. The transcript also has the following SNPs as listed in Table 29 (given according to their position on the nucleotide sequence, with the alternative nucleic acid listed; the last column indicates whether the SNP is known or not; the presence of known SNPs in variant protein HSMUC1A_PEA.sub.--1_P63 (SEQ ID NO:819) sequence provides support for the deduced sequence of this variant protein according to the present invention). TABLE-US-01309 TABLE 29 Nucleic acid SNPs SNP position on Alternative Previously nucleotide sequence nucleic acid known SNP? 572 A→G No 900 A→No 904 C→No 963 A→C Yes 1211 A→G No 1219 C→T No 1225 C→T Yes 1270 C→T Yes 1323 C→T No 1343 C→T Yes 1449 G→No 1461 G→A Yes 1462 C→No 1462 C→T No 1551 A→T No As noted above, cluster HSMUC1A features 22 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSMUC1A_PEA.sub.--1_node.sub.--0 (SEQ ID NO:783) according to the present invention is supported by 31 libraries. The number of libraries was determined as previously described. This segment can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773), HSMUC1A_PEA.sub.--1_T31 (SEQ ID NO:774), HSMUC1A_PEA.sub.--1_T33 (SEQ ID NO:775), HSMUC1A_PEA.sub.--1_T34 (SEQ ID NO:776), HSMUC1A_PEA.sub.--1_T35 (SEQ ID NO:777), HSMUC1A_PEA.sub.--1_T36 (SEQ ID NO:778), HSMUC1A_PEA.sub.--1_T40 (SEQ ID NO:779), HSMUC1A_PEA.sub.--1_T42 (SEQ ID NO:780), HSMUC1A_PEA.sub.--1_T43 (SEQ ID NO:781) and HSMUC1A_PEA.sub.--1_T47 (SEQ ID NO:782). Table 30 below describes the starting and ending position of this segment on each transcript. TABLE-US-01310 TABLE 30 Segment location on transcripts Segment Segment starting ending Transcript name position position HSMUC1A_PEA_1_T12 1 564 (SEQ ID NO:769) HSMUC1A_PEA_1_T26 1 564 (SEQ ID NO:770) HSMUC1A_PEA_1_T28 1 564 (SEQ ID NO:771) HSMUC1A_PEA_1_T29 1 564 (SEQ ID NO:772) HSMUC1A_PEA_1_T30 1 564 (SEQ ID NO:773) HSMUC1A_PEA_1_T31 1 564 (SEQ ID NO:774) HSMUC1A_PEA_1_T33 1 564 (SEQ ID NO:775) HSMUC1A_PEA_1_T34 1 564 (SEQ ID NO:776) HSMUC1A_PEA_1_T35 1 564 (SEQ ID NO:777) HSMUC1A_PEA_1_T36 1 564 (SEQ ID NO:778) HSMUC1A_PEA_1_T40 1 564 (SEQ ID NO:779) HSMUC1A_PEA_1_T42 1 564 (SEQ ID NO:780) HSMUC1A_PEA_1_T43 1 564 (SEQ ID NO:781) HSMUC1A_PEA_1_T47 1 564 (SEQ ID NO:782)

Segment cluster HSMUC1A_PEA.sub.--1_node.sub.--14 (SEQ ID NO:784) according to the present invention is supported by 55 libraries. The number of libraries was determined as previously described. This segment can be found in the following transcript(s): HSMUC1A_PEA.sub.--1_T12 (SEQ ID NO:769). Table 31 below describes the starting and ending position of this segment on each transcript. TABLE-US-01311 TABLE 31 Segment location on transcripts Segment Segment starting ending Transcript name position position HSMUC1A_PEA_1_T12 666 841 (SEQ ID NO:769)

Segment cluster HSMUC1A_PEA.sub.--1_node.sub.--24 (SEQ ID NO:785) according to the present invention is supported by 135 libraries. The number of libraries was determined as previously described. This segment can be found in the following transcript(s): HSMUC1A_PEA.sub.--1_T12 (SEQ ID NO:769). Table 32 below describes the starting and ending position of this segment on each transcript. TABLE-US-01312 TABLE 32 Segment location on transcripts Segment Segment starting ending Transcript name position position HSMUC1A_PEA_1_T12 953 1084 (SEQ ID NO:769)

Segment cluster HSMUC1A_PEA.sub.--1_node.sub.--29 (SEQ ID NO:786) according to the present invention is supported by 156 libraries. The number of libraries was determined as previously described. This segment can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773), HSMUC1A_PEA.sub.--1_T31 (SEQ ID NO:774), HSMUC1A_PEA.sub.--1_T33 (SEQ ID NO:775), HSMUC1A_PEA.sub.--1_T34 (SEQ ID NO:776), HSMUC1A_PEA.sub.--1_T35 (SEQ ID NO:777), HSMUC1A_PEA.sub.--1_T36 (SEQ ID NO:778), HSMUC1A_PEA.sub.--1_T40 (SEQ ID NO:779), HSMUC1A_PEA.sub.--1_T42 (SEQ ID NO:780) and HSMUC1A_PEA.sub.--1_T43 (SEQ ID NO:781). Table 33 below describes the starting and ending position of this segment on each transcript. TABLE-US-01313 TABLE 33 Segment location on transcripts Segment Segment starting ending Transcript name position position HSMUC1A_PEA_1_T12 1207 1346 (SEQ ID NO:769) HSMUC1A_PEA_1_T26 894 1033 (SEQ ID NO:770) HSMUC1A_PEA_1_T28 913 1052 (SEQ ID NO:771) HSMUC1A_PEA_1_T29 865 1004 (SEQ ID NO:772) HSMUC1A_PEA_1_T30 838 977 (SEQ ID NO:773) HSMUC1A_PEA_1_T31 788 927 (SEQ ID NO:774) HSMUC1A_PEA_1_T33 881 1020 (SEQ ID NO:775) HSMUC1A_PEA_1_T34 783 922 (SEQ ID NO:776) HSMUC1A_PEA_1_T35 862 1001 (SEQ ID NO:777) HSMUC1A_PEA_1_T36 756 895 (SEQ ID NO:778) HSMUC1A_PEA_1_T40 762 901 (SEQ ID NO:779) HSMUC1A_PEA_1_T42 772 911 (SEQ ID NO:780) HSMUC1A_PEA_1_T43 693 832 (SEQ ID NO:781)

Segment cluster HSMUC1A_PEA.sub.--1_node.sub.--35 (SEQ ID NO:787) according to the present invention is supported by 51 libraries. The number of libraries was determined as previously described. This segment can be found in the following transcript(s): HSMUC1A_PEA.sub.--1_T47 (SEQ ID NO:782). Table 34 below describes the starting and ending position of this segment on each transcript. TABLE-US-01314 TABLE 34 Segment location on transcripts Segment Segment starting ending Transcript name position position HSMUC1A_PEA_1_T47 666 1189 (SEQ ID NO:782)

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to breast cancer), shown in Table 35. TABLE-US-01315 TABLE 35 Oligonucleotides related to this segment Oligonucleotide Overexpressed in Chip name cancers reference HSMUC1A_0_0_11365 breast malignant BRS (SEQ ID NO:917) tumors Segment cluster HSMUC1A_PEA.sub.--1_node.sub.--38 (SEQ ID NO:788) according to the present invention is supported by 140 libraries. The number of libraries was determined as previously described. This segment can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773), HSMUC1A_PEA.sub.--1_T31 (SEQ ID NO:774), HSMUC1A_PEA.sub.--1_T33 (SEQ ID NO:775), HSMUC1A_PEA.sub.--1_T34 (SEQ ID NO:776), HSMUC1A_PEA.sub.--1_T35 (SEQ ID NO:777), HSMUC1A_PEA.sub.--1_T36 (SEQ ID NO:778), HSMUC1A_PEA.sub.--1_T40 (SEQ ID NO:779), HSMUC1A_PEA.sub.--1_T42 (SEQ ID NO:780), HSMUC1A_PEA.sub.--1_T43 (SEQ ID NO:781) and HSMUC1A_PEA.sub.--1_T47 (SEQ ID NO:782). Table 36 below describes the starting and ending position of this segment on each transcript. TABLE-US-01316 TABLE 36 Segment location on transcripts Segment Segment starting ending Transcript name position position HSMUC1A_PEA_1_T12 1488 1749 (SEQ ID NO:769) HSMUC1A_PEA_1_T26 1175 1436 (SEQ ID NO:770) HSMUC1A_PEA_1_T28 1194 1455 (SEQ ID NO:771) HSMUC1A_PEA_1_T29 1146 1407 (SEQ ID NO:772) HSMUC1A_PEA_1_T30 1119 1380 (SEQ ID NO:773) HSMUC1A_PEA_1_T31 1069 1330 (SEQ ID NO:774) HSMUC1A_PEA_1_T33 1162 1423 (SEQ ID NO:775) HSMUC1A_PEA_1_T34 1064 1325 (SEQ ID NO:776) HSMUC1A_PEA_1_T35 1143 1404 (SEQ ID NO:777) HSMUC1A_PEA_1_T36 1037 1298 (SEQ ID NO:778) HSMUC1A_PEA_1_T40 1043 1304 (SEQ ID NO:779) HSMUC1A_PEA_1_T42 1053 1314 (SEQ ID NO:780) HSMUC1A_PEA_1_T43 974 1235 (SEQ ID NO:781) HSMUC1A_PEA_1_T47 1321 1582 (SEQ ID NO:782)

According to an optional embodiment of the present invention, short segments related to the above cluster are also provided. These segments are up to about 120 bp in length, and so are included in a separate description.

Segment cluster HSMUC1A_PEA.sub.--1_node.sub.--3 (SEQ ID NO:789) according to the present invention is supported by 17 libraries. The number of libraries was determined as previously described. This segment can be found in the following transcript(s): HSMUC1A_PEA.sub.--1_T29 (SEQ ID NO:772), HSMUC1A_PEA.sub.--1_T34 (SEQ ID NO:776), HSMUC1A_PEA.sub.--1_T40 (SEQ ID NO:779) and HSMUC1A_PEA.sub.--1_T43 (SEQ ID NO:781). Table 37 below describes the starting and ending position of this segment on each transcript. TABLE-US-01317 TABLE 37 Segment location on transcripts Segment Segment starting ending Transcript name position position HSMUC1A_PEA_1_T29 565 591 (SEQ ID NO:772) HSMUC1A_PEA_1_T34 565 591 (SEQ ID NO:776) HSMUC1A_PEA_1_T40 565 591 (SEQ ID NO:779) HSMUC1A_PEA_1_T43 565 591 (SEQ ID NO:781)

Segment cluster HSMUC1A_PEA.sub.--1_node.sub.--4 (SEQ ID NO:790) according to the present invention can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773), HSMUC1A_PEA.sub.--1_T31 (SEQ ID NO:774), HSMUC1A_PEA.sub.--1_T33 (SEQ ID NO:775), HSMUC1A_PEA.sub.--1_T34 (SEQ ID NO:776), HSMUC1A_PEA.sub.--1_T35 (SEQ ID NO:777), HSMUC1A_PEA.sub.--1_T36 (SEQ ID NO:778), HSMUC1A_PEA.sub.--1_T40 (SEQ ID NO:779), HSMUC1A_PEA.sub.--1_T42 (SEQ ID NO:780), HSMUC1A_PEA.sub.--1_T43 (SEQ ID NO:781) and HSMUC1A_PEA.sub.--1_T47 (SEQ ID NO:782). Table 38 below describes the starting and ending position of this segment on each transcript. TABLE-US-01318 TABLE 38 Segment location on transcripts Segment Segment starting ending Transcript name position position HSMUC1A_PEA_1_T12 565 573 (SEQ ID NO:769) HSMUC1A_PEA_1_T26 565 573 (SEQ ID NO:770) HSMUC1A_PEA_1_T28 565 573 (SEQ ID NO:771) HSMUC1A_PEA_1_T29 592 600 (SEQ ID NO:772) HSMUC1A_PEA_1_T30 565 573 (SEQ ID NO:773) HSMUC1A_PEA_1_T31 565 573 (SEQ ID NO:774) HSMUC1A_PEA_1_T33 565 573 (SEQ ID NO:775) HSMUC1A_PEA_1_T34 592 600 (SEQ ID NO:776) HSMUC1A_PEA_1_T35 565 573 (SEQ ID NO:777) HSMUC1A_PEA_1_T36 565 573 (SEQ ID NO:778) HSMUC1A_PEA_1_T40 592 600 (SEQ ID NO:779) HSMUC1A_PEA_1_T42 565 573 (SEQ ID NO:780) HSMUC1A_PEA_1_T43 592 600 (SEQ ID NO:781) HSMUC1A_PEA_1_T47 565 573 (SEQ ID NO:782)

Segment cluster HSMUC1A_PEA.sub.--1_node.sub.--5 (SEQ ID NO:791) according to the present invention is supported by 34 libraries. The number of libraries was determined as previously described. This segment can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773), HSMUC1A_PEA.sub.--1_T31 (SEQ ID NO:774), HSMUC1A_PEA.sub.--1_T33 (SEQ ID NO:775), HSMUC1A_PEA.sub.--1_T34 (SEQ ID NO:776), HSMUC1A_PEA.sub.--1_T35 (SEQ ID NO:777), HSMUC1A_PEA.sub.--1_T36 (SEQ ID NO:778), HSMUC1A_PEA.sub.--1_T40 (SEQ ID NO:779), HSMUC1A_PEA.sub.--1_T42 (SEQ ID NO:780), HSMUC1A_PEA.sub.--1_T43 (SEQ ID NO:781) and HSMUC1A_PEA.sub.--1_T47 (SEQ ID NO:782). Table 39 below describes the starting and ending position of this segment on each transcript. TABLE-US-01319 TABLE 39 Segment location on transcripts Segment Segment starting ending Transcript name position position HSMUC1A_PEA_1_T12 574 600 (SEQ ID NO: 769) HSMUC1A_PEA_1_T26 574 600 (SEQ ID NO: 770) HSMUC1A_PEA_1_T28 574 600 (SEQ ID NO: 771) HSMUC1A_PEA_1_T29 601 627 (SEQ ID NO: 772) HSMUC1A_PEA_1_T30 574 600 (SEQ ID NO: 773) HSMUC1A_PEA_1_T31 574 600 (SEQ ID NO: 774) HSMUC1A_PEA_1_T33 574 600 (SEQ ID NO: 775) HSMUC1A_PEA_1_T34 601 627 (SEQ ID NO: 776) HSMUC1A_PEA_1_T35 574 600 (SEQ ID NO: 777) HSMUC1A_PEA_1_T36 574 600 (SEQ ID NO: 778) HSMUC1A_PEA_1_T40 601 627 (SEQ ID NO: 779) HSMUC1A_PEA_1_T42 574 600 (SEQ ID NO: 780) HSMUC1A_PEA_1_T43 601 627 (SEQ ID NO: 781) HSMUC1A_PEA_1_T47 574 600 (SEQ ID NO: 782)

Segment cluster HSMUC1A_PEA.sub.--1_node.sub.--6 (SEQ ID NO:792) according to the present invention is supported by 35 libraries. The number of libraries was determined as previously described. This segment can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773), HSMUC1A_PEA.sub.--1_T31 (SEQ ID NO:774), HSMUC1A_PEA.sub.--1_T33 (SEQ ID NO:775), HSMUC1A_PEA.sub.--1_T34 (SEQ ID NO:776), HSMUC1A_PEA.sub.--1_T35 (SEQ ID NO:777), HSMUC1A_PEA.sub.--1_T36 (SEQ ID NO:778), HSMUC1A_PEA.sub.--1_T40 (SEQ ID NO:779), HSMUC1A_PEA.sub.--1_T42 (SEQ ID NO:780), HSMUC1A_PEA.sub.--1_T43 (SEQ ID NO:781) and HSMUC1A_PEA.sub.--1_T47 (SEQ ID NO:782). Table 40 below describes the starting and ending position of this segment on each transcript. TABLE-US-01320 TABLE 40 Segment location on transcripts Segment Segment starting ending Transcript name position position HSMUC1A_PEA_1_T12 601 638 (SEQ ID NO: 769) HSMUC1A_PEA_1_T26 601 638 (SEQ ID NO: 770) HSMUC1A_PEA_1_T28 601 638 (SEQ ID NO: 771) HSMUC1A_PEA_1_T29 628 665 (SEQ ID NO: 772) HSMUC1A_PEA_1_T30 601 638 (SEQ ID NO: 773) HSMUC1A_PEA_1_T31 601 638 (SEQ ID NO: 774) HSMUC1A_PEA_1_T33 601 638 (SEQ ID NO: 775) HSMUC1A_PEA_1_T34 628 665 (SEQ ID NO: 776) HSMUC1A_PEA_1_T35 601 638 (SEQ ID NO: 777) HSMUC1A_PEA_1_T36 601 638 (SEQ ID NO: 778) HSMUC1A_PEA_1_T40 628 665 (SEQ ID NO: 779) HSMUC1A_PEA_1_T42 601 638 (SEQ ID NO: 780) HSMUC1A_PEA_1_T43 628 665 (SEQ ID NO: 781) HSMUC1A_PEA_1_T47 601 638 (SEQ ID NO: 782)

Segment cluster HSMUC1A_PEA.sub.--1_node.sub.--7 (SEQ ID NO:793) according to the present invention is supported by 32 libraries. The number of libraries was determined as previously described. This segment can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773), HSMUC1A_PEA.sub.--1_T31 (SEQ ID NO:774), HSMUC1A_PEA.sub.--1_T33 (SEQ ID NO:775), HSMUC1A_PEA.sub.--1_T34 (SEQ ID NO:776), HSMUC1A_PEA.sub.--1_T35 (SEQ ID NO:777), HSMUC1A_PEA.sub.--1_T36 (SEQ ID NO:778), HSMUC1A_PEA.sub.--1_T40 (SEQ ID NO:779), HSMUC1A_PEA.sub.--1_T42 (SEQ ID NO:780) and HSMUC1A_PEA.sub.--1_T43 (SEQ ID NO:781). Table 42 below describes the starting and ending position of this segment on each transcript. TABLE-US-01321 TABLE 42 Segment location on transcripts Segment Segment starting ending Transcript name position position HSMUC1A_PEA__1_T12 639 665 (SEQ ID NO: 769) HSMUC1A_PEA__1_T26 639 665 (SEQ ID NO: 770) HSMUC1A_PEA__1_T28 639 665 (SEQ ID NO: 771) HSMUC1A_PEA__1_T29 666 692 (SEQ ID NO: 772) HSMUC1A_PEA__1_T30 639 665 (SEQ ID NO: 773) HSMUC1A_PEA__1_T31 639 665 (SEQ ID NO: 774) HSMUC1A_PEA__1_T33 639 665 (SEQ ID NO: 775) HSMUC1A_PEA__1_T34 666 692 (SEQ ID NO: 776) HSMUC1A_PEA__1_T35 639 665 (SEQ ID NO: 777) HSMUC1A_PEA__1_T36 639 665 (SEQ ID NO: 778) HSMUC1A_PEA__1_T40 666 692 (SEQ ID NO: 779) HSMUC1A_PEA__1_T42 639 665 (SEQ ID NO: 780) HSMUC1A_PEA__1_T43 666 692 (SEQ ID NO: 781)

Segment cluster HSMUC1A_PEA.sub.--1_node.sub.--17 (SEQ ID NO:794) according to the present invention can be found in the following transcript(s): HSMUC1A_PEA.sub.--1_T28 (SEQ ID NO:771), HSMUC1A_PEA.sub.--1_T33 (SEQ ID NO:775) and HSMUC1A_PEA.sub.--1_T40 (SEQ ID NO:779). Table 44 below describes the starting and ending position of this segment on each transcript. TABLE-US-01322 TABLE 44 Segment location on transcripts Segment Segment starting ending Transcript name position position HSMUC1A_PEA__1_T28 666 684 (SEQ ID NO: 771) HSMUC1A_PEA__1_T33 666 684 (SEQ ID NO: 775) HSMUC1A_PEA__1_T40 693 711 (SEQ ID NO: 779)

Segment cluster HSMUC1A_PEA.sub.--1_node.sub.--18 (SEQ ID NO:795) according to the present invention is supported by 90 libraries. The number of libraries was determined as previously described. This segment can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773), HSMUC1A_PEA.sub.--1_T33 (SEQ ID NO:775), HSMUC1A_PEA.sub.--1_T35 (SEQ ID NO:777), HSMUC1A_PEA.sub.--1_T40 (SEQ ID NO:779) and HSMUC1A_PEA.sub.--1_T42 (SEQ ID NO:780). Table 45 below describes the starting and ending position of this segment on each transcript. TABLE-US-01323 TABLE 45 Segment location on transcripts Segment Segment starting ending Transcript name position position HSMUC1A_PEA__1_T12 842 891 (SEQ ID NO: 769) HSMUC1A_PEA__1_T26 666 715 (SEQ ID NO: 770) HSMUC1A_PEA__1_T28 685 734 (SEQ ID NO: 771) HSMUC1A_PEA__1_T29 693 742 (SEQ ID NO: 772) HSMUC1A_PEA__1_T30 666 715 (SEQ ID NO: 773) HSMUC1A_PEA__1_T33 685 734 (SEQ ID NO: 775) HSMUC1A_PEA__1_T35 666 715 (SEQ ID NO: 777) HSMUC1A_PEA__1_T40 712 761 (SEQ ID NO: 779) HSMUC1A_PEA__1_T42 666 715 (SEQ ID NO: 780)

Segment cluster HSMUC1A_PEA.sub.--1_node.sub.--20 (SEQ ID NO:796) according to the present invention can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T33 (SEQ ID NO:775), HSMUC1A_PEA.sub.--1_T35 (SEQ ID NO:777) and HSMUC1A_PEA.sub.--1_T42 (SEQ ID NO:780). Table 46 below describes the starting and ending position of this segment on each transcript. TABLE-US-01324 TABLE 46 Segment location on transcripts Segment Segment starting ending Transcript name position position HSMUC1A_PEA__1_T12 892 900 (SEQ ID NO: 769) HSMUC1A_PEA__1_T26 716 724 (SEQ ID NO: 770) HSMUC1A_PEA__1_T28 735 743 (SEQ ID NO: 771) HSMUC1A_PEA__1_T33 735 743 (SEQ ID NO: 775) HSMUC1A_PEA__1_T35 716 724 (SEQ ID NO: 777) HSMUC1A_PEA__1_T42 716 724 (SEQ ID NO: 780)

Segment cluster HSMUC1A_PEA.sub.--1_node.sub.--21 (SEQ ID NO:797) according to the present invention is supported by 97 libraries. The number of libraries was determined as previously described. This segment can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T33 (SEQ ID NO:775), HSMUC1A_PEA.sub.--1_T35 (SEQ ID NO:777) and HSMUC1A_PEA.sub.--1_T42 (SEQ ID NO:780). Table 47 below describes the starting and ending position of this segment on each transcript. TABLE-US-01325 TABLE 47 Segment location on transcripts Segment Segment starting ending Transcript name position position HSMUC1A_PEA__1_T12 901 947 (SEQ ID NO: 769) HSMUC1A_PEA__1_T26 725 771 (SEQ ID NO: 770) HSMUC1A_PEA__1_T28 744 790 (SEQ ID NO: 771) HSMUC1A_PEA__1_T33 744 790 (SEQ ID NO: 775) HSMUC1A_PEA__1_T35 725 771 (SEQ ID NO: 777) HSMUC1A_PEA__1_T42 725 771 (SEQ ID NO: 780)

Segment cluster HSMUC1A_PEA.sub.--1_node.sub.--23 (SEQ ID NO:798) according to the present invention can be found in the following transcript(s): HSMUC1A_PEA.sub.--1_T12 (SEQ ID NO:769). Table 48 below describes the starting and ending position of this segment on each transcript. TABLE-US-01326 TABLE 48 Segment location on transcripts Segment Segment starting ending Transcript name position position HSMUC1A_PEA__1_T12 948 952 (SEQ ID NO: 769)

Segment cluster HSMUC1A_PEA.sub.--1_node.sub.--26 (SEQ ID NO:799) according to the present invention is supported by 129 libraries. The number of libraries was determined as previously described. This segment can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773) and HSMUC1A_PEA.sub.--1_T31 (SEQ ID NO:774). Table 49 below describes the starting and ending position of this segment on each transcript. TABLE-US-01327 TABLE 49 Segment location on transcripts Segment Segment starting ending Transcript name position position HSMUC1A_PEA__1_T12 1085 1116 (SEQ ID NO: 769) HSMUC1A_PEA__1_T26 772 803 (SEQ ID NO: 770) HSMUC1A_PEA__1_T28 791 822 (SEQ ID NO: 771) HSMUC1A_PEA__1_T29 743 774 (SEQ ID NO: 772) HSMUC1A_PEA__1_T30 716 747 (SEQ ID NO: 773) HSMUC1A_PEA__1_T31 666 697 (SEQ ID NO: 774)

Segment cluster HSMUC1A_PEA.sub.--1_node.sub.--27 (SEQ ID NO:800) according to the present invention is supported by 140 libraries. The number of libraries was determined as previously described. This segment can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773), HSMUC1A_PEA.sub.--1_T31 (SEQ ID NO:774), HSMUC1A_PEA.sub.--1_T33 (SEQ ID NO:775), HSMUC1A_PEA.sub.--1_T34 (SEQ ID NO:776), HSMUC1A_PEA.sub.--1_T35 (SEQ ID NO:777) and HSMUC1A_PEA.sub.--1_T36 (SEQ ID NO:778). Table 50 below describes the starting and ending position of this segment on each transcript. TABLE-US-01328 TABLE 50 Segment location on transcripts Segment Segment starting ending Transcript name position position HSMUC1A_PEA__1_T12 1117 1206 (SEQ ID NO: 769) HSMUC1A_PEA__1_T26 804 893 (SEQ ID NO: 770) HSMUC1A_PEA__1_T28 823 912 (SEQ ID NO: 771) HSMUC1A_PEA__1_T29 775 864 (SEQ ID NO: 772) HSMUC1A_PEA__1_T30 748 837 (SEQ ID NO: 773) HSMUC1A_PEA__1_T31 698 787 (SEQ ID NO: 774) HSMUC1A_PEA__1_T33 791 880 (SEQ ID NO: 775) HSMUC1A_PEA__1_T34 693 782 (SEQ ID NO: 776) HSMUC1A_PEA__1_T35 772 861 (SEQ ID NO: 777) HSMUC1A_PEA__1_T36 666 755 (SEQ ID NO: 778)

Segment cluster HSMUC1A_PEA.sub.--1_node.sub.--31 (SEQ ID NO:801) according to the present invention can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773), HSMUC1A_PEA.sub.--1_T31 (SEQ ID NO:774), HSMUC1A_PEA.sub.--1_T33 (SEQ ID NO:775), HSMUC1A_PEA.sub.--1_T34 (SEQ ID NO:776), HSMUC1A_PEA.sub.--1_T35 (SEQ ID NO:777), HSMUC1A_PEA.sub.--1_T36 (SEQ ID NO:778), HSMUC1A_PEA.sub.--1_T40 (SEQ ID NO:779), HSMUC1A_PEA.sub.--1_T42 (SEQ ID NO:780) and HSMUC1A_PEA.sub.--1_T43 (SEQ ID NO:781). Table 51 below describes the starting and ending position of this segment on each transcript. TABLE-US-01329 TABLE 51 Segment location on transcripts Segment Segment starting ending Transcript name position position HSMUC1A_PEA__1_T12 1347 1356 (SEQ ID NO: 769) HSMUC1A_PEA__1_T26 1034 1043 (SEQ ID NO: 770) HSMUC1A_PEA__1_T28 1053 1062 (SEQ ID NO: 771) HSMUC1A_PEA__1_T29 1005 1014 (SEQ ID NO: 772) HSMUC1A_PEA__1_T30 978 987 (SEQ ID NO: 773) HSMUC1A_PEA__1_T31 928 937 (SEQ ID NO: 774) HSMUC1A_PEA__1_T33 1021 1030 (SEQ ID NO: 775) HSMUC1A_PEA__1_T34 923 932 (SEQ ID NO: 776) HSMUC1A_PEA__1_T35 1002 1011 (SEQ ID NO: 777) HSMUC1A_PEA__1_T36 896 905 (SEQ ID NO: 778) HSMUC1A_PEA__1_T40 902 911 (SEQ ID NO: 779) HSMUC1A_PEA__1_T42 912 921 (SEQ ID NO: 780) HSMUC1A_PEA__1_T43 833 842 (SEQ ID NO: 781)

Segment cluster HSMUC1A_PEA.sub.--1_node.sub.--34 (SEQ ID NO:802) according to the present invention is supported by 24 libraries. The number of libraries was determined as previously described. This segment can be found in the following transcript(s): HSMUC1A_PEA.sub.--1_T47 (SEQ ID NO:782). Table 52 below describes the starting and ending position of this segment on each transcript. TABLE-US-01330 TABLE 52 Segment location on transcripts Segment Segment starting ending Transcript name position position HSMUC1A_PEA__1_T47 639 665 (SEQ ID NO: 782)

Segment cluster HSMUC1A_PEA.sub.--1_node.sub.--36 (SEQ ID NO:803) according to the present invention is supported by 135 libraries. The number of libraries was determined as previously described. This segment can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773), HSMUC1A_PEA.sub.--1_T31 (SEQ ID NO:774), HSMUC1A_PEA.sub.--1_T33 (SEQ ID NO:775), HSMUC1A_PEA.sub.--1_T34 (SEQ ID NO:776), HSMUC1A_PEA.sub.--1_T35 (SEQ ID NO:777), HSMUC1A_PEA.sub.--1_T36 (SEQ ID NO:778), HSMUC1A_PEA.sub.--1_T40 (SEQ ID NO:779), HSMUC1A_PEA.sub.--1_T42 (SEQ ID NO:780), HSMUC1A_PEA.sub.--1_T43 (SEQ ID NO:781) and HSMUC1A_PEA.sub.--1_T47 (SEQ ID NO:782). Table 53 below describes the starting and ending position of this segment on each transcript. TABLE-US-01331 TABLE 53 Segment location on transcripts Segment Segment starting ending Transcript name position position HSMUC1A_PEA__1_T12 1357 1388 (SEQ ID NO: 769) HSMUC1A_PEA__1_T26 1044 1075 (SEQ ID NO: 770) HSMUC1A_PEA__1_T28 1063 1094 (SEQ ID NO: 771) HSMUC1A_PEA__1_T29 1015 1046 (SEQ ID NO: 772) HSMUC1A_PEA__1_T30 988 1019 (SEQ ID NO: 773) HSMUC1A_PEA__1_T31 938 969 (SEQ ID NO: 774) HSMUC1A_PEA__1_T33 1031 1062 (SEQ ID NO: 775) HSMUC1A_PEA__1_T34 933 964 (SEQ ID NO: 776) HSMUC1A_PEA__1_T35 1012 1043 (SEQ ID NO: 777) HSMUC1A_PEA__1_T36 906 937 (SEQ ID NO: 778) HSMUC1A_PEA__1_T40 912 943 (SEQ ID NO: 779) HSMUC1A_PEA__1_T42 922 953 (SEQ ID NO: 780) HSMUC1A_PEA__1_T43 843 874 (SEQ ID NO: 781) HSMUC1A_PEA__1_T47 1190 1221 (SEQ ID NO: 782)

Segment cluster HSMUC1A_PEA.sub.--1_node.sub.--37 (SEQ ID NO:804) according to the present invention is supported by 146 libraries. The number of libraries was determined as previously described. This segment can be found in the following transcript(s): HSMUC1A_PEA.sub.--1_T12 (SEQ ID NO:769), HSMUC1A_PEA.sub.--1_T26 (SEQ ID NO:770), HSMUC1A_PEA.sub.--1_T28 (SEQ ID NO:771), HSMUC1A_PEA.sub.--1_T29 (SEQ ID NO:772), HSMUC1A_PEA.sub.--1_T30 (SEQ ID NO:773), HSMUC1A_PEA.sub.--1_T31 (SEQ ID NO:774), HSMUC1A_PEA.sub.--1_T33 (SEQ ID NO:775), HSMUC1A_PEA.sub.--1_T34 (SEQ ID NO:776), HSMUC1A_PEA.sub.--1_T35 (SEQ ID NO:777), HSMUC1A_PEA.sub.--1_T36 (SEQ ID NO:778), HSMUC1A_PEA.sub.--1_T40 (SEQ ID NO:779), HSMUC1A_PEA.sub.--1_T42 (SEQ ID NO:780), HSMUC1A_PEA.sub.--1_T43 (SEQ ID NO:781) and HSMUC1A_PEA.sub.--1_T47 (SEQ ID NO:782). Table 54 below describes the starting and ending position of this segment on each transcript. TABLE-US-01332 TABLE 54 Segment location on transcripts Segment Segment starting ending Transcript name position position HSMUC1A_PEA__1_T12 1389 1487 (SEQ ID NO: 769) HSMUC1A_PEA__1_T26 1076 1174 (SEQ ID NO: 770) HSMUC1A_PEA__1_T28 1095 1193 (SEQ ID NO: 771) HSMUC1A_PEA__1_T29 1047 1145 (SEQ ID NO: 772) HSMUC1A_PEA__1_T30 1020 1118 (SEQ ID NO: 773) HSMUCIA_PEA__1_T31 970 1068 (SEQ ID NO: 774) HSMUC1A_PEA__1_T33 1063 1161 (SEQ ID NO: 775) HSMUC1A_PEA__1_T34 965 1063 (SEQ ID NO: 776) HSMUC1A_PEA__1_T35 1044 1142 (SEQ ID NO: 777) HSMUC1A_PEA__1_T36 938 1036 (SEQ ID NO: 778) HSMUC1A_PEA__1_T40 944 1042 (SEQ ID NO: 779) HSMUC1A_PEA__1_T42 954 1052 (SEQ ID NO: 780) HSMUC1A_PEA__1_T43 875 973 (SEQ ID NO: 781) HSMUC1A_PEA__1_T47 1222 1320 (SEQ ID NO: 782)

Variant Protein Alignment to the Previously Known Protein:
Sequence name: MUC1_HUMAN (SEQ ID NO:805)
Sequence Documentation:
Alignment of: HSMUC1A_PEA.sub.--1_P63 (SEQ ID NO:819).times.MUC1_HUMAN (SEQ ID NO:805).
Alignment segment 1/1: TABLE-US-01333 Quality: 429.00 Escore: 0 Matching length: 59 Total length: 59 Matching Percent 86.44 Matching Percent Identity: 81.36 Similarity: Total Percent Similarity: 86.44 Total Percent Identity: 81.36 Gaps: 0

```
Alignment: TABLE-US-01334 . . . 1
MTPGTQSPFFLLLLLTVLTVVTGSGHASSTPGGEKETSATQRSSVEEEVS        50
|||||||||||||||||||||||||||||||||||||||||||||||||         1
MTPGTQSPFFLLLLLTVLTVVTGSGHASSTPGGEKETSATQRSSVPSSTE      5051

ADQVSVGAS                                                 59
: ||:  :|
KNAVSMTSS                                                 59
```

Combined Expression of 8 Sequences (T10888seg11-17 (SEQ ID NO: 832), HUMGR5E junc3-7 (SEQ ID NO: 857), HSSTROL3seg24 (SEQ ID NO: 869), T94936 Seg 14 (SEQ ID NO: 861), Z21368 seg39 (SEQ ID NO: 844), Z21368 junc17-21 (SEQ ID NO: 847), T59832 jun6-25-26 (SEQ ID NO: 854) and M85491seg24 (SEQ ID NO: 866)) in Normal and Cancerous Breast Tissues Expression of CEA6_HUMAN Carcinoembryonic antigen-related cell adhesion molecule 6, GRP_HUMAN-gastrin-releasing peptide, Stromelysin-3 precursor (EC 3.4.24.-) (Matrix metalloproteinase-11) (MMP-11) (ST3) (SL-3), Homo sapiens breast cancer membran protein 11 (BCMP11), SUL1_HUMAN, Ephrin type-B receptor2 precursor (EC 2.7.1.112) (Tyrosine-protein kinase receptor EPH-3 and gamma-interferon inducible lysosomal thiol recductase (GILT) transcripts detectable by or according to T10888seg11-17 (SEQ ID NO: 832), HUMGR5E junc3-7 (SEQ ID NO: 857), HSSTROL3seg24 (SEQ ID NO: 869), T94936 Seq 14 (SEQ ID NO: 861), Z21368 seg39 (SEQ ID NO: 844), Z21368 junc17-21 (SEQ ID NO: 874), T58832 jun6-25-26 (SEQ ID NO: 854) and M85491seg24 (SEQ ID NO: 866) amplicons and T10888seg11-17F (SEQ ID NO: 830), T10888seg11-17R (SEQ ID NO: 831), HUMGR5E junc3-7F(SEQ ID NO: 855), HUMGR5E junc3-7F (SEQ ID NO: 856), HSSTROL3seg24F (SEQ ID NO:867), HSSTROL3seg24R (SEQ ID NO: 868), T94936seg14F (SEQ ID NO: 859), T94936seg14R (SEQ ID NO: 860), Z21368 seg39F (SEQ ID NO: 842), Z21368 seg39R (SEQ ID NO: 843), Z21368junc17-21 F (SEQ ID NO: 845), Z21368junc17-21R (SEQ ID NO: 846), T59832 jun6-25-26F (SEQ ID NO: 852), T59832jun6-25-26F (SEQ ID NO: 853), M85491seg24F (SEQ ID NO: 864) and M85491seg24R (SEQ ID NO: 865) primers was measured by real time PCR. In parallel the expression of four housekeeping genes-PBGD (GenBank Accession No. BC019323 (SEQ ID NO:926); amplicon--PBGD-amplicon (SEQ ID NO:929)), HPRT1 (GenBank Accession No. NM.sub.--000194 (SEQ ID NO:930); amplicon--HPRT1-amplicon (SEQ ID NO:933), G6PD (GenBank Accession No. NM.sub.--000402 (SEQ ID NO:918); G6PD-amplicon (SEQ ID NO:921)) and SDHA (GenBank Accession No. NM.sub.--004168 (SEQ ID NO:922); amplicon--SDHA-amplicon (SEQ ID NO:925)) was measured similarly. For each RT sample, the expression of the above amplicons was normalized to the geometric mean of the quantities of the housekeeping genes. The normalized quantity of each RT sample of each amplicon was then divided by the median of the quantities of the normal post-mortem (PM) samples detected for the same amplicon (Sample Nos. 56-60, 63-67 Table 1, "Tissue samples in testing panel" above), to obtain a value of fold up-regulation for each sample relative to median of the normal PM samples.

FIGS. 44-47 are histograms showing differential expression of the above-indicated transcripts in cancerous breast samples relative to the normal samples, in different combinations. The number and percentage of samples that exhibit at least 5 fold differential of at least one of the sequences, out of the total number of samples tested is indicated in the bottom.

As is evident from FIGS. 44-47, differential expression of at least 5 fold in at least one of the sequences was found in 25 out of 28 adenocarcinoma samples in all different combinations.

Statistical analysis was applied to verify the significance of these results, as described below. Threshold of 5 fold differential expression of at least one of the amplicons was found to differentiate between cancer and normal samples.

The above values demonstrate statistical significance of the results.

Description for Cluster HSU33147

Cluster HSU33147 features 2 transcript(s) and 5 segment(s) of interest, the names for which are given in Tables 1 and 2, respectively, the sequences themselves are given at the end of the application. The selected protein variants are given in table 3. TABLE-US-01335 TABLE 1 Transcripts of interest Transcript Name Sequence ID No. HSU33147_PEA_1_T1820 HSU33147_PEA_1_T2 821

TABLE-US-01336 TABLE 2 Segments of interest Segment Name Sequence ID No. HSU33147_PEA_1_node_0 822 HSU33147_PEA_1_node_2 823 HSU33147_PEA_1_node_4 824 HSU33147_PEA_1_node_7 825 HSU33147_PEA_1_node_3 826

TABLE-US-01337 TABLE 3 Proteins of interest Sequence ID Corresponding Protein Name No. Transcript(s) HSU33147_PEA_1_P5 828 HSU33147_PEA_1_T1; (SEQ ID NO: 820) HSU33147_PEA_1_T2 (SEQ ID NO: 821)

These sequences are variants of the known protein Mammaglobin A precursor (SwissProt accession identifier MGBA_HUMAN; known also according to the synonyms Mammaglobin 1; Secretoglobin family 2A member 2), SEQ ID NO: 827, referred to herein as the previously known protein.

The sequence for protein Mammaglobin A precursor (SEQ ID NO:827) is given at the end of the application, as "Mammaglobin A precursor (SEQ ID NO:827) amino acid sequence".

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Immunostimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer.

The following GO Annotation(s) apply to the previously known protein. The following annotation(s) were found: steroid binding, which are annotation(s) related to Molecular Function.

The GO assignment relies on information from one or more of the SwissProt/TremBI Protein knowledgebase, available from expasy.ch/sprot/; or Locuslink, available from ncbi.nlm.nih.gov/projects/LocusLink/.

Cluster HSU33147 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 48 refer to weighted expression of ESTs in each category, as "parts per million" (ratio of the expression of ESTs for a particular cluster to the expression of all ESTs in that category, according to parts per million).

Figure 48:
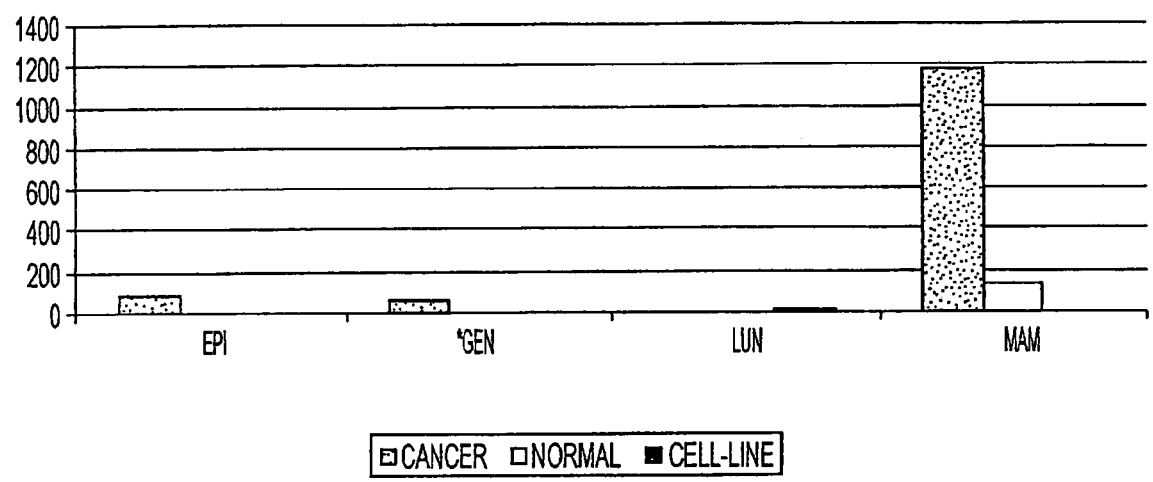
FIG. 48 is a histogram showing Cancer and cell-line vs. normal tissue expression for Cluster HSU33147, demonstrating overexpression in a mixture of malignant tumors from different tissues.

Overall, the following results were obtained as shown with regard to the histograms in FIG. 48 and Table 4. This cluster is overexpressed (at least at a minimum level) in the following pathological conditions: a mixture of malignant tumors from different tissues. TABLE-US-01338 TABLE 4 Normal tissue distribution Name of Tissue Number epithelial 6 general 2 lung 0 breast 131

TABLE-US-01339 TABLE 5 P values and ratios for expression in cancerous tissue Name of Tissue P1 P2 SP1 R3 SP2 R4 epithelial 4.1e-02 6.4e-02 1.5e-12 2.6 2.2e-06 1.5 general 1.6e-02 1.1e-02 1.2e-22 4.4 7.2e-13 2.4 lung 1 6.3e-01 1 1.0 6.2e-01 1.6 breast 8.6e-02 1.1e-01 3.4e-07 1.7 2.6e-03 1.0

As noted above, cluster HSU33147 features 2 transcript(s), which were listed in Table 1 above. These transcript(s) encode for protein(s) which are variant(s) of protein Mammaglobin A precursor (SEQ ID NO:827). A description of each variant protein according to the present invention is now provided.

Variant protein HSU33147_PEA.sub.--1_P5 (SEQ ID NO:828) according to the present invention has an amino acid sequence as given at the end of the application; it is encoded by transcript(s) HSU33147_PEA.sub.--1_T1 (SEQ ID NO:820). An alignment is given to the known protein (Mammaglobin A precursor (SEQ ID NO:827) ) at the end of the application. One or more alignments to one or more previously published protein sequences are given at the end of the application. A brief description of the relationship of the variant protein according to the present invention to each such aligned protein is as follows:

Comparison report between HSU33147_PEA.sub.--1_P5 (SEQ ID NO:828) and MGBA_HUMAN (SEQ ID NO:827):

1. An isolated chimeric polypeptide encoding for HSU33147_PEA.sub.--1_P5 (SEQ ID NO:828), comprising a first amino acid sequence being at least 90% homologous to MKLLMVLMLAALSQHCYAGSGCPLLEN-VISKTINPQVSKTEYKELLQEFIDDNATTNAI DELKECFLNQTDETLSNVE corresponding to amino acids 1-78 of MGBA_HUMAN (SEQ ID NO:827), which also corresponds to amino acids 1-78 of HSU33147_PEA.sub.--1_P5 (SEQ ID NO:828), and a second amino acid sequence being at least 90% homologous to QLIYDSSLCDLF corresponding to amino acids 82-93 of MGBA_HUMAN (SEQ ID NO:827) which also corresponds to amino acids 79-90 of HSU33147_PEA.sub.--1_P5 (SEQ ID NO:828), wherein said first amino acid sequence and second amino acid sequence are contiguous and in a sequential order.

2. An isolated chimeric polypeptide encoding for an edge portion of HSU33147_PEA.sub.--1_P5 (SEQ ID NO:828), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EQ, having a structure as follows: a sequence starting from any of amino acid numbers 78-x to 78; and ending at any of amino acid numbers 79+((n−2)-x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein HSU33147_PEA.sub.--1_P5 (SEQ ID NO:828), as compared to the known protein Mammaglobin A precursor (SEQ ID NO:827), are described in Table 6 (given according to their position(s) on the amino acid sequence in the first column; the second column indicates whether the glycosylation site is present in the variant protein; and the last column indicates whether the position is different on the variant protein). TABLE-US-01340 TABLE 6 Glycosylation site(s) Position(s) on known amino Present in acid sequence variant protein? Position in variant protein? 68 yes 68 53 yes 53

Variant protein HSU33147_PEA.sub.--1_P5 (SEQ ID NO:828) is encoded by the following transcript(s): HSU33147_PEA.sub.--1_T1 (SEQ ID NO:820), for which the sequence(s) is/are given at the end of the application. The coding portion of transcript HSU33147_PEA.sub.--1_T1 (SEQ ID NO:820) is shown in bold; this coding portion starts at position 72 and ends at position 341. The transcript also has the following SNPs as listed in Table 7 (given according to their position on the nucleotide sequence, with the alternative nucleic acid listed; the last column indicates whether the SNP is known or not; the presence of known SNPs in variant protein HSU33147_PEA.sub.--1_P5 (SEQ ID NO:828) sequence provides support for the deduced sequence of this variant protein according to the present invention). TABLE-US-01341 TABLE 7 Nucleic acid SNPs SNP position on Alternative Previously nucleotide sequence nucleic acid known SNP? 84 A→C No 124 C→No 396 A→G No As noted above, cluster HSU33147 features 5 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSU33147_PEA.sub.--1_node.sub.--0 (SEQ ID NO:822) according to the present invention is supported by 38 libraries. The number of libraries was determined as previously described. This segment can be found in the following transcript(s): HSU33147_PEA.sub.--1_T1 (SEQ ID NO:820) and HSU33147_PEA.sub.--1_T2 (SEQ ID NO:821). Table 8 below describes the starting and ending position of this segment on each transcript. TABLE-US-01342 TABLE 8 Segment location on transcripts Segment Segment starting ending Transcript name position position ending position of this segment on each transcript. TABLE-US-01345 TABLE 11 Segment location on transcripts Segment Segment starting ending Transcript name position position HSU33147_PEA__1_T1 306 516 (SEQ ID NO: 820)

According to an optional embodiment of the present invention, short segments related to the above cluster are also provided. These segments are up to about 120 bp in length, and so are included in a separate description.

Segment cluster HSU33147_PEA.sub.--1_node.sub.--3 (SEQ ID NO:826) according to the present invention can be found in the following transcript(s): HSU33147_PEA.sub.--1_T2 (SEQ ID NO:821) Table 12 below describes the starting and ending position of this segment on each transcript. TABLE-US-01346 TABLE 12 Segment location on transcripts Segment Segment starting ending Transcript name position position HSU33147_PEA__1_T2 306 314 (SEQ ID NO: 821)

Sequence name: MGBA_HUMAN (SEQ ID NO:827)

Sequence Documentation:

Alignment of: HSU33147_PEA.sub.--1_P5 (SEQ ID NO:828).times.MGBA_HUMAN (SEQ ID NO:827).

Alignment segment 1/1: TABLE-US-01347 Quality: 776.00 Escore: 0 Matching length: 90 Total length: 93 Matching Percent 100.00 Matching Percent Identity: 100.00 Similarity: Total Percent Similarity: 96.77 Total Percent Identity: 96.77 Gaps: 1

```
Alignment: TABLE-US-01348 . . . 1
MKLLMVLMLAALSQHCYAGSGCPLLENVISKTINPQVSKTEYKELLQEFI          50
|||||||||||||||||||||||||||||||||||||||||||||||||           1
MKLLMVLMLAALSQHCYAGSGCPLLENVISKTINPQVSKTEYKELLQEFI          50 . . . 51

DDNATTNAIDELKECFLNQTDETLSNVE...QLIYDSSLCDLF                 90
|||||||||||||||||||||||||||    ||||||||||||                 51
DDNATTNAIDELKECFLNQTDETLSNVEVFMQLIYDSSLCDLF                 93
```

HSU33147_PEA__1_T1 1 126 (SEQ ID NO: 820) HSU33147_PEA__1_T2 1 126 (SEQ ID NO: 821)

Segment cluster HSU33147_PEA.sub.--1_node.sub.--2 (SEQ ID NO:823) according to the present invention is supported by 44 libraries. The number of libraries was determined as previously described. This segment can be found in the following transcript(s): HSU33147_PEA.sub.--1_T1 (SEQ ID NO:820) and HSU33147_PEA.sub.--1_T2 (SEQ ID NO:821). Table 9 below describes the starting and ending position of this segment on each transcript. TABLE-US-01343 TABLE 9 Segment location on transcripts Segment Segment starting ending Transcript name position position HSU33147_PEA__1_T1 127 305 (SEQ ID NO: 820) HSU33147_PEA__1_T2 127 305 (SEQ ID NO: 821)

Segment cluster HSU33147_PEA.sub.--1_node.sub.--4 (SEQ ID NO:824) according to the present invention is supported by 3 libraries. The number of libraries was determined as previously described. This segment can be found in the following transcript(s): HSU33147_PEA.sub.--1_T2 (SEQ ID NO:821). Table 10 below describes the starting and ending position of this segment on each transcript. TABLE-US-01344 TABLE 10 Segment location on transcripts Segment Segment starting ending Transcript name position position HSU33147_PEA__1_T2 315 907 (SEQ ID NO: 821)

Segment cluster HSU33147_PEA.sub.--1_node.sub.--7 (SEQ ID NO:825) according to the present invention is supported by 35 libraries. The number of libraries was determined as previously described. This segment can be found in the following transcript(s): HSU33147_PEA.sub.--1_T1 (SEQ ID NO:820). Table 11 below describes the starting and It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims. All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. Sequence CWU 0 SQTB SEQUENCE LISTING

SEQUENCE LISTING (1028 sequences)

SEQ ID NO: 1 - DNA, 2518 bp, Homo sapiens
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctgattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaa

SEQ ID NO: 2 - DNA, 2376 bp, Homo sapiens
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctcttgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaa

SEQ ID NO: 3 - DNA, 3004 bp, Homo sapiens
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggtaagtggatccatgaagcactagcatcacattttcaggtggagtctggctctcagagaagagccaggaagaaattttctttcccaacctgtgtccaaggggcacacgcaaatcccaaattctcccctgaaccctcccaattcacctctgcagactcttttccccttgtttttttgttttttgttgttttttgttttttgatttctcatgtctgactttgggtccatcctggaatgagaggagggggctccctcagcactgagccctgtgtagtgaaaggggcttcacagagaaaaaaggaggaagggtcctcagggtcaagttcctgctctctgtcaccaacaattccctttctgtcacttctttgtgttcttttacctactccataagctacaagggacaaggaggttttgaaatgagctcacactttttccttaaatgagaagaggaagccccttgggtgatggaggagcagctcagactctgcccccatctctgctcccagcacccccagtgactgactgaccccaccctgaagccacctaaggtggaaccagggcatatggagaaggtgcccaggtgtctgtcctgaatcaggctaaatcaagatgctaatcaacaccaaagcctcccctggatcaggccgcaggaaaatgggaagacatggagcctcatgacagactgctgagctgtgtcctggctctgaagtcactggctgtataagactgtgggcacagcacatgggacacagcacagaggacagcaagtgacgcacacttggagacatagggagattcagccatggggactctgcatggcagggaaggggcagtgccaaaaagtgtgtatttatagagaggataagactaccagccactatgtatctaatataggacttaccttttcaacccttccacgtgtgcaggtccgtagtattaaacacattcccgttgttctgctaccatcaccaccacccacccacagaactctcttcttcctcccaaaatgaaactctgttcccatcaaactcctgggcagagctgcccacctgtgacccacagcctgacccctgaactcacctctagacttgcttctggtctcccgctcaaacccccatccccatcatcacccatctccaggatgtccttaaatagcaaagcctcagaaaaaacacaccttggctgggtggtgtgggactgtgcagctgaaagaaacagcacctgcatgttccaggtgagtaccccaaaagaccaggcagtcagccagtcagggaagaaacaggagaggtgccagaggctgtggctgtcagtcctgtatctgcccaagactcaatgcttctgccctattcacatttgagaaagtctgtacttctcccacacaaagcaggtggcctcgatctccgagccctcagatcgttgtgcatccgtcttctgacacacacacctgccctgggctcttaaggacttgggtggactgaggggtgggagatgccaactctgactgaacgatgcctgcagaggaatcaaaggtgccacacacggcaatcttctctctgttttctgcacagcggagctgcccaagccctcggtcaccagcaacaactccaaccctgtagagttttctacatataagtttaagttatctgtgaacagagataattttacttctttccgatttggatgtctgtttatttgtttgtttgctgcctaatttctccagctaggacttaaaatactatgttgaagagaagtggggcaagcaggcatccttgtcttgctcctggtcttacagggaaagctttcagtctttctccattgagtatccctctattatgttgaggtggtttccttccattcacagagtgtttttatttataaaagaatgttgaattttgtc

SEQ ID NO: 4 - DNA, 1410 bp, Homo sapiens
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtataccgtgagtatttccacatgacctctgggtgttgggggtcagttctacttcccacatacgggattgtcaggcctgggttgtgcctgtggccctctctgcattacatcctgtatcagggtttggacatttagtgcaggacacacacgggggagacaaacttccacagatcagaattcctttcctggatccagaccctgcagacactcgctgcagaggaaggacagtctgatggggggactcagcagggcgaggtcagtgtcagacaagcaccccatggtctccccatggacctgaccctgagaaagaccctggagaactggatcagggcctggcctgaggggtccccctagggacccctcagagagaagctcaactcttccctgaactgagcccctgtacaaagccctgtccctggttcctgattccaggtgatcctggggagtctgtgccagggctgtgtggtggcctcttgggcagggctggctgggagcaaggatgtgagctatccaagggccatgactcctggagttggtcaccagccaggtccgagcacccagagcctcatctagctgaggatagggcctcctccttcacttgaggctcagcatggaaaggacagatggaaaaaattactagtgcatgagcccactgccctgggggacacaggttactccctgggaagttcagagtccccaaggggaggaacagagaagagaggatgctcctggcagctccatgtccaccagggatcaggcccagggccctctgtcttggaagcaaataatcatagataactgttcacttgggcagctcctctgtgcagagctgagatcaagtaa

SEQ ID NO: 5 - DNA, 255 bp, Artificial
  Synthetic oligonucleotide
atggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctg

SEQ ID NO: 6 - DNA, 1896 bp, Artificial
  Synthetic oligonucleotide
gtaagtggatccatgaagcactagcatcacattttcaggtggagtctggctctcagagaagagccaggaagaaattttctttcccaacctgtgtccaaggggcacacgcaaatcccaaattctcccctgaaccctcccaattcacctctgcagactcttttccccttgtttttttgttttttgttgttttttgttttttgatttctcatgtctgactttgggtccatcctggaatgagaggagggggctccctcagcactgagccctgtgtagtgaaaggggcttcacagagaaaaaaggaggaagggtcctcagggtcaagttcctgctctctgtcaccaacaattccctttctgtcacttctttgtgttcttttacctactccataagctacaagggacaaggaggttttgaaatgagctcacactttttccttaaatgagaagaggaagccccttgggtgatggaggagcagctcagactctgcccccatctctgctcccagcacccccagtgactgactgaccccaccctgaagccacctaaggtggaaccagggcatatggagaaggtgcccaggtgtctgtcctgaatcaggctaaatcaagatgctaatcaacaccaaagcctcccctggatcaggccgcaggaaaatgggaagacatggagcctcatgacagactgctgagctgtgtcctggctctgaagtcactggctgtataagactgtgggcacagcacatgggacacagcacagaggacagcaagtgacgcacacttggagacatagggagattcagccatggggactctgcatggcagggaaggggcagtgccaaaaagtgtgtatttatagagaggataagactaccagccactatgtatctaatataggacttaccttttcaacccttccacgtgtgcaggtccgtagtattaaacacattcccgttgttctgctaccatcaccaccacccacccacagaactctcttcttcctcccaaaatgaaactctgttcccatcaaactcctgggcagagctgcccacctgtgacccacagcctgacccctgaactcacctctagacttgcttctggtctcccgctcaaacccccatccccatcatcacccatctccaggatgtccttaaatagcaaagcctcagaaaaaacacaccttggctgggtggtgtgggactgtgcagctgaaagaaacagcacctgcatgttccaggtgagtaccccaaaagaccaggcagtcagccagtcagggaagaaacaggagaggtgccagaggctgtggctgtcagtcctgtatctgcccaagactcaatgcttctgccctattcacatttgagaaagtctgtacttctcccacacaaagcaggtggcctcgatctccgagccctcagatcgttgtgcatccgtcttctgacacacacacctgccctgggctcttaaggacttgggtggactgaggggtgggagatgccaactctgactgaacgatgcctgcagaggaatcaaaggtgccacacacggcaatcttctctctgttttctgcacagcggagctgcccaagccctcggtcaccagcaacaactccaaccctgtagagttttctacatataagtttaagttatctgtgaacagagataattttacttctttccgatttggatgtctgtttatttgtttgtttgctgcctaatttctccagctaggacttaaaatactatgttgaagagaagtggggcaagcaggcatccttgtcttgctcctggtcttacagggaaagctttcagtctttctccattgagtatccctctattatgttgaggtggtttccttccattcacagagtgtttttatttataaaagaatgttgaattttgtc

SEQ ID NO: 7 - DNA, 1410 bp, Artificial
  Synthetic oligonucleotide
attggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaa

SEQ ID NO: 8 - DNA, 214 bp, Artificial
  Synthetic oligonucleotide
tgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacag

SEQ ID NO: 9 - DNA, 360 bp, Artificial
  Synthetic oligonucleotide
cctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacc

SEQ ID NO: 10 - DNA, 836 bp, Artificial
  Synthetic oligonucleotide
gtgagtatttccacatgacctctgggtgttgggggtcagttctacttcccacatacgggattgtcaggcctgggttgtgcctgtggccctctctgcattacatcctgtatcagggtttggacatttagtgcaggacacacacgggggagacaaacttccacagatcagaattcctttcctggatccagaccctgcagacactcgctgcagaggaaggacagtctgatggggggactcagcagggcgaggtcagtgtcagacaagcaccccatggtctccccatggacctgaccctgagaaagaccctggagaactggatcagggcctggcctgaggggtccccctagggacccctcagagagaagctcaactcttccctgaactgagcccctgtacaaagccctgtccctggttcctgattccaggtgatcctggggagtctgtgccagggctgtgtggtggcctcttgggcagggctggctgggagcaaggatgtgagctatccaagggccatgactcctggagttggtcaccagccaggtccgagcacccagagcctcatctagctgaggatagggcctcctccttcacttgaggctcagcatggaaaggacagatggaaaaaattactagtgcatgagcccactgccctgggggacacaggttactccctgggaagttcagagtccccaaggggaggaacagagaagagaggatgctcctggcagctccatgtccaccagggatcaggcccagggccctctgtcttggaagcaaataatcatagataactgttcacttgggcagctcctctgtgcagagctgagatcaagtaa

SEQ ID NO: 11 - DNA, 279 bp, Artificial
  Synthetic oligonucleotide
cggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctct

SEQ ID NO: 12 - DNA, 113 bp, Artificial
  Synthetic oligonucleotide
tgctcctgtcctctcagctgtggccaccgtcggcatcacgattggagtgctggccagggtggctctgatatagcagccctggtgtattttcgatatttcaggaagactggcag

SEQ ID NO: 13 - protein, 344 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDVPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 14 - protein, 324 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDVPTISPSKANYRPGENLNLSCHAASNPPAQYSWFINGTFQQSTQELFIPNITVNNSGSYMCQAHNSATGLNRTTVTMITVSDWTRP

SEQ ID NO: 15 - protein, 256 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLLLLSSQLWPPSASRLECWPGWL

SEQ ID NO: 16 - protein, 390 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDVPTISPSKANYRPGENLNLSCHAASNPPAQYSWFINGTFQQSTQELFIPNITVNNSGSYMCQAHNSATGLNRTTVTMITVSGKWIHEALASHFQVESGSQRRARKKFSFPTCVQGAHANPKFSPEPSQFTSADSFPLVFLFFVVFCFLISHV

SEQ ID NO: 17 - protein, 183 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYREYFHMTSGCWGSVLLPTYGIVRPGLCLWPSLHYILYQGLDI

SEQ ID NO: 18 - DNA, 2199 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaaaaaaaagckataat

SEQ ID NO: 19 - DNA, 1947 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaaaaaaaagckataat

SEQ ID NO: 20 - DNA, 1592 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaaggtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacct

SEQ ID NO: 21 - DNA, 2490 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaaaaaaaagckataat

SEQ ID NO: 22 - DNA, 810 bp, Artificial
  Synthetic oligonucleotide
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctgg

SEQ ID NO: 23 - DNA, 168 bp, Artificial
  Synthetic oligonucleotide
gtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacct

SEQ ID NO: 24 - DNA, 157 bp, Artificial
  Synthetic oligonucleotide
ggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagg

SEQ ID NO: 25 - DNA, 198 bp, Artificial
  Synthetic oligonucleotide
gtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcag

SEQ ID NO: 26 - DNA, 153 bp, Artificial
  Synthetic oligonucleotide
ggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctg

SEQ ID NO: 27 - DNA, 140 bp, Artificial
  Synthetic oligonucleotide
gccatcccgcgccacgtggctgtccttgttctccagtgaggagagcaacttgggagccaacaactatgatgactacaggatggactggcttgtgcctgccacctgtgaacccatccagagtgtcttcttcttctctggag

SEQ ID NO: 28 - DNA, 127 bp, Artificial
  Synthetic oligonucleotide
acaagtactaccgagtcaatcttcgcacacggcgagtggacactgtggaccctccctacccacgctccatcgctcagtactggctgggctgcccagctcctggccatctgtaggagtcagagcccac

SEQ ID NO: 29 - DNA, 223 bp, Artificial
  Synthetic oligonucleotide
tgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggataga

SEQ ID NO: 30 - DNA, 9 bp, Artificial
  Synthetic oligonucleotide
ctgaccaag

SEQ ID NO: 31 - DNA, 44 bp, Artificial
  Synthetic oligonucleotide
ggagacctcagcccccagcagaggaggagctgtgcagtgggaag

SEQ ID NO: 32 - DNA, 38 bp, Artificial
  Synthetic oligonucleotide
cccttcgacgccttcaccgacctcaagaacggttccct

SEQ ID NO: 33 - DNA, 14 bp, Artificial
  Synthetic oligonucleotide
ctttgccttccgag

SEQ ID NO: 34 - DNA, 32 bp, Artificial
  Synthetic oligonucleotide
ggcagtactgctatgaactggacgaaaaggca

SEQ ID NO: 35 - DNA, 24 bp, Artificial
  Synthetic oligonucleotide
gtgaggcctgggtaccccaagctc

SEQ ID NO: 36 - DNA, 84 bp, Artificial
  Synthetic oligonucleotide
atccgagatgtctggggcatcgagggccccatcgatgccgccttcacccgcatcaactgtcaggggaagacctacctcttcaag

SEQ ID NO: 37 - DNA, 42 bp, Artificial
  Synthetic oligonucleotide
ctggtaccagacagccccagttcattagccgggactggcacg

SEQ ID NO: 38 - DNA, 51 bp, Artificial
  Synthetic oligonucleotide
gtgtgccagggcaagtggacgcagccatggctggccgcatctacatctcag

SEQ ID NO: 39 - DNA, 9 bp, Artificial
  Synthetic oligonucleotide
gcatggcac

SEQ ID NO: 40 - DNA, 95 bp, Artificial
  Synthetic oligonucleotide
cccgcccctccttggccaagaaacaaaggtttaggcatcgcaaccgcaaaggctaccgttcacaacgaggccacagccgtggccgcaaccagaac

SEQ ID NO: 41 - DNA, 42 bp, Artificial
  Synthetic oligonucleotide
agtcatgcaagggccgctgcactgagggcttcaacgtggaca

SEQ ID NO: 42 - DNA, 8 bp, Artificial
  Synthetic oligonucleotide
tcccgccg

SEQ ID NO: 43 - DNA, 7 bp, Artificial
  Synthetic oligonucleotide
atggccg

SEQ ID NO: 44 - DNA, 17 bp, Artificial
  Synthetic oligonucleotide
ggccctctgtagctccc

SEQ ID NO: 45 - DNA, 62 bp, Artificial
  Synthetic oligonucleotide
tcctcccatctccttcccccagcccaataaaggtcccttagccccgaaaaaaaagckataat

SEQ ID NO: 46 - DNA, 20 bp, Artificial
  Synthetic oligonucleotide
agaagtgccagtgtgacgag

SEQ ID NO: 47 - DNA, 58 bp, Artificial
  Synthetic oligonucleotide
ctctgctcttactaccagagctgctgcacagactatacggctgagtgcaagccccaag

SEQ ID NO: 48 - DNA, 6 bp, Artificial
  Synthetic oligonucleotide
ctcaag

SEQ ID NO: 49 - DNA, 20 bp, Artificial
  Synthetic oligonucleotide
gcctgagacccttcatccag

SEQ ID NO: 50 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 51 - protein, 283 aa, Homo sapiens [sequence omitted]

SEQ ID NO: 52 - protein, 447 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 53 - protein, 363 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSDKYYRVNLRTRRVDTVDPPYPRSIAQYWLGCPAPGHL

SEQ ID NO: 54 - protein, 238 aa, Homo sapiens [sequence omitted]

SEQ ID NO: 55 - DNA, 4755 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 56 - DNA, 4677 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 57 - DNA, 2790 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacatcccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagagaaaatatttgtataattttttta

SEQ ID NO: 58 - DNA, 3069 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtgtgtcattgttcctcctctcagccagccccaaatacactgagctccagctggtgcccagagccagccagcagctgaagacatggaggcagaatatgccttgcccacaaggatcaccccaagctgagcatttctcagctgcttgtgaatagcatattgatggagatgcactcatggtctgtgggaagtgagaggtgtttctttaaataagctgttagcacagatccatttggaaaaacgtccagatgccaaaagtaaatattatcattttgctttcaggtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacatcccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagagaaaatatttgtataattttttta

SEQ ID NO: 59 - DNA, 5384 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttgtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaaccctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttttttctg

SEQ ID NO: 60 - DNA, 4524 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttgtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaaccctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 61 - DNA, 4454 bp, Homo sapiens
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 62 - DNA, 327 bp, Artificial
  Synthetic oligonucleotide
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcag

SEQ ID NO: 63 - DNA, 177 bp, Artificial
  Synthetic oligonucleotide
aactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaa

SEQ ID NO: 64 - DNA, 240 bp, Artificial
  Synthetic oligonucleotide
ggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacag

SEQ ID NO: 65 - DNA, 300 bp, Artificial
  Synthetic oligonucleotide
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggctttt

SEQ ID NO: 66 - DNA, 152 bp, Artificial
  Synthetic oligonucleotide
ccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaag

SEQ ID NO: 67 - DNA, 176 bp, Artificial
  Synthetic oligonucleotide
ctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaat

SEQ ID NO: 68 - DNA, 129 bp, Artificial
  Synthetic oligonucleotide
agtcccacagatcgttctcaacattgacttggcccccacgatcctggatattgctgggctcgacacacctcctgatgtggacggcaagtctgtcctcaaacttctggacccagaaaagccaggtaacag

SEQ ID NO: 69 - DNA, 279 bp, Artificial
  Synthetic oligonucleotide
gtgtgtcattgttcctcctctcagccagccccaaatacactgagctccagctggtgcccagagccagccagcagctgaagacatggaggcagaatatgccttgcccacaaggatcaccccaagctgagcatttctcagctgcttgtgaatagcatattgatggagatgcactcatggtctgtgggaagtgagaggtgtttctttaaataagctgttagcacagatccatttggaaaaacgtccagatgccaaaagtaaatattatcattttgctttcag

SEQ ID NO: 70 - DNA, 853 bp, Artificial
  Synthetic oligonucleotide
gtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacatcccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagagaaaatatttgtataattttttta

SEQ ID NO: 71 - DNA, 162 bp, Artificial
  Synthetic oligonucleotide
ggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagag

SEQ ID NO: 72 - DNA, 130 bp, Artificial
  Synthetic oligonucleotide
caaatttctacgtaagaaggaagaatccagcaagaatatccaacagtcaaatcacttgcccaaatatgaacgggtcaaagaactatgccagcaggccaggtaccagacagcctgtgaacaaccggggcag

SEQ ID NO: 73 - DNA, 217 bp, Artificial
  Synthetic oligonucleotide
aagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaa

SEQ ID NO: 74 - DNA, 256 bp, Artificial
  Synthetic oligonucleotide
agtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaa

SEQ ID NO: 75 - DNA, 176 bp, Artificial
  Synthetic oligonucleotide
ggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacc

SEQ ID NO: 76 - DNA, 143 bp, Artificial
  Synthetic oligonucleotide
tgggatctttctgtgcttgcacgagttctaacaataacacctactggtgtttgcgtacagttaatgagacgcataattttcttttctgtgagtttgctactggctttttggagtattttgatatgaatacagatccttatcag

SEQ ID NO: 77 - DNA, 124 bp, Artificial
  Synthetic oligonucleotide
ctcacaaatacagtgcacacggtagaacgaggcattttgaatcagctacacgtacaactaatggagctcagaagctgtcaaggatataagcagtgcaacccaagacctaagaatcttgatgttg

SEQ ID NO: 78 - DNA, 588 bp, Artificial
  Synthetic oligonucleotide
aggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaag

SEQ ID NO: 79 - DNA, 585 bp, Artificial
  Synthetic oligonucleotide
aacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaa

SEQ ID NO: 80 - DNA, 1188 bp, Artificial
  Synthetic oligonucleotide
ttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttttttctg

SEQ ID NO: 81 - DNA, 45 bp, Artificial
  Synthetic oligonucleotide
gaccctatctgcagatgttctgaatacctctgagaatagagattg

SEQ ID NO: 82 - DNA, 28 bp, Artificial
  Synthetic oligonucleotide
attattcaaccaggatacctaattcaag

SEQ ID NO: 83 - DNA, 15 bp, Artificial
  Synthetic oligonucleotide
aacatccgacccaac

SEQ ID NO: 84 - DNA, 40 bp, Artificial
  Synthetic oligonucleotide
attattcttgtgcttaccgatgatcaagatgtggagctgg

SEQ ID NO: 85 - DNA, 74 bp, Artificial
  Synthetic oligonucleotide
gactacttcacagacttaatcactaacgagagcattaattacttcaaaatgtctaagagaatgtatccccatag

SEQ ID NO: 86 - DNA, 96 bp, Artificial
  Synthetic oligonucleotide
gcccgttatgatggtgatcagccacgctgcgccccacggccccgaggactcagccccacagttttctaaactgtaccccaatgcttcccaacacat

SEQ ID NO: 87 - DNA, 59 bp, Artificial
  Synthetic oligonucleotide
aactcctagttataactatgcaccaaatatggataaacactggattatgcagtacacag

SEQ ID NO: 88 - DNA, 92 bp, Artificial
  Synthetic oligonucleotide
gaccaatgctgcccatccacatggaatttacaaacattctacagcgcaaaaggctccagactttgatgtcagtggatgattctgtggagagg

SEQ ID NO: 89 - DNA, 57 bp, Artificial
  Synthetic oligonucleotide
gtttcgaacaaacaagaaggccaaaatttggcgtgatacattcctagtggaaagagg

SEQ ID NO: 90 - DNA, 97 bp, Artificial
  Synthetic oligonucleotide
gtgttttattcttcccaatgactctatccattgtgagagagaactgtaccaatcggccagagcgtggaaggaccataaggcatacattgacaaagag

SEQ ID NO: 91 - DNA, 95 bp, Artificial
  Synthetic oligonucleotide
attgaagctctgcaagataaaattaagaatttaagagaagtgagaggacatctgaagagaaggaagcctgaggaatgtagctgcagtaaacaaag

SEQ ID NO: 92 - DNA, 66 bp, Artificial
  Synthetic oligonucleotide
ctattacaataaagagaaaggtgtaaaaaagcaagagaaattaaagagccatcttcacccattcaa

SEQ ID NO: 93 - DNA, 34 bp, Artificial
  Synthetic oligonucleotide
gaaataaagatggaggaagctatgacctacacag

SEQ ID NO: 94 - DNA, 53 bp, Artificial
  Synthetic oligonucleotide
cttgacacccctggtaaatctttcaacacacttccactgcctgcgtaatgaag

SEQ ID NO: 95 - DNA, 95 bp, Artificial
  Synthetic oligonucleotide
gtgctgacggccacccaccatcatctaaagaagataaacttggcaaatgacatgcaggttcttcaaggcagaataattgcagaaaatcttcaaag

SEQ ID NO: 96 - protein, 871 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 97 - protein, 790 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNPHKYSAHGRTRHFESATRTTNGAQKLSRI

SEQ ID NO: 98 - protein, 791 aa, Homo sapiens
MKYSCCALVLAVLGTELLGSLCSTVRSPRFRGRIQQERKNIRPNIILVLTDDQDVELAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 99 - protein, 416 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERG

SEQ ID NO: 100 - protein, 410 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRCVIVPPLSQPQIH

SEQ ID NO: 101 - protein, 210 aa, Homo sapiens [sequence omitted]

SEQ ID NO: 102 - protein, 145 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTGLLHRLNH

SEQ ID NO: 103 - DNA, 1084 bp, Homo sapiens
gagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgaaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 104 - DNA, 1019 bp, Homo sapiens
gagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggagtgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 105 - DNA, 761 bp, Homo sapiens
gagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagtgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 106 - DNA, 1800 bp, Homo sapiens
ctgtctcctcagtttaagtgatcctcctgcctcagcttccccagtagctgggactacaggtgtgcaccaccatgcccggctaatttttgtatttttagtagagacagtgttcaccatgttggccaggctggtctcaaactcctgacctcaagttatccgcctgtcccagcctcccaaaggattacaggtgtaagccaccacgcccggccccagcctcccctcttgaagcctccatctctgaatcaggggaatgaatgcaggtctcttaggagcatgagtgatcacagaggacttactggaggaggcatttctgagctgggcatggaaggatgagcaggaatgtgcagagacacagatgatgggatgtggagatgataggacagaccccacctacttccccgggggattgtgaagaatgactcccagagaagtgactcattggctccaatcatttattcattcatcaaacatccgggtcacccaagaggcctcacctagtgacaccctagtcctgcagggttagatcagggctgagagagtggcaaggagagggcactgaggagacactgtggaaggaggatgaagggtgttcctggcagagggatcagcctgtgtggaggtcctgagtaaagtgagatactatgggggtcagaggcagtgggtctggtcttagggatgaaaccaagggagctaggaggcaggagcagcccaagccctgccttaggggcctccactcaagcatgtattgagcacctgctgtttgtgggctttgtcgcatcactgtgaagccaactgtaccctcttctcagtgacgaaacaggcttggctcagggctggtgggcgggaccgttgagataacggggaggaagctgaggcaaccccctgctccccacccacccagtgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatggggtaagaatctttttagccctcagcttgacactcatagtcccatggagtcagggatggacaagacagagggaccagagataaaggaacccaggcggaggttgcagtgagctgagatcatgccactgcactccagcctgggcaacaagagcaaaacttgatagctttgcatagggaaagagggcattgatgctggggttttgaaaggtgagtaggagtccatcaggcaaaaaaagtatgtattaattcgaagtattaaacatccctagccacccccattgggaaagatgtgccactgatttgcgaggcgggaggcgggggccagacttgggaatatgtgcagccctttctgggctggaaccagggtgcatgggttggggtagctgctgggaatatgcgacccctgtcttgctttgtgcagaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 107 - DNA, 2178 bp, Homo sapiens
gagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaaggtagggacggcgacagggcgggcaggctggagggaacaggcgccctgtcggggcacgcggctccttctttctccccagacttcacaggggaagaccagggccccgaggggacgctgtccctgccgggttcctggaaaaaccctgttcagttcccggcgctgcggccacactccctccgtgccgtttcgctttcgcatcccgcatctgagaggcgcagctgcctccacccgcctagtcccgcccaagggttcaatgagcgcctactgtgtacttttggggcaggagctggggtctccttttgtggcccagggcacaagttcagcagctggccaagggccgccggcatgcattcttgctgctacccttgatgcattcattccagccagggcagggctcgcgtgtctttgggacctattaggcagatgccctagaggctgagcgacttgctcaccgctccagcgacatgggccacccgccacccctcagctgaagccggaagtcagcacctattaggtgccgcctctattcagtcggacttggaaagggttcacgtggatcccttgctcagctcagaggcaaggtctccaggtgaagtgacaagaaatgagcatgggccaaggccggaggcggtggctcatgcctgtaatcccaacactttggaagtctgaggcaggcagatcacgaggtcaggagttcgagaccattctggcctacatggagaaaccctgtctctactaaaaatacaaaaattagctgggtgtggtggcatgtgcctataatcccagctactcaggaggctgaggcaggacaattgcttgaaccagggagtcgggtgttgcagtgagccgagatcgtgccgcagcacaccagcctagcgacagtgagactccatctcaaaaaaaaaaaaaaaagtctcaaagtcaagattccacctggcaagttctggaaggcgtgcaagatgaattgcgtatcacagccccctttctacaagactaccaagtggggttgagagaagtggggaactgcccagggctacacctgcctcccacgccttcctaatccacagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 108 - DNA, 1530 bp, Homo sapiens
gagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatggggtaagaatctttttagccctcagcttgacactcatagtcccatggagtcagggatggacaagacagagggaccagagataaaggaacccaggcggaggttgcagtgagctgagatcatgccactgcactccagcctgggcaacaagagcaaaacttgatagctttgcatagggaaagagggcattgatgctggggttttgaaaggtgagtaggagtccatcaggcaaaaaaagtatgtattaattcgaagtattaaacatccctagccacccccattgggaaagatgtgccactgatttgcgaggcgggaggcgggggccagacttgggaatatgtgcagccctttctgggctggaaccagggtgcatgggttggggtagctgctgggaatatgcgacccctgtcttgctttgtgcagaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 109 - DNA, 123 bp, Artificial
  Synthetic oligonucleotide
gagtggaggagggagagacgctggcccgggacccgaggggcgtgggcatcgggaggcgggcccgggttaggggcgggaccgccgcctggttaaaggcgcttatttcccaggcagccgctgcag

SEQ ID NO: 110 - DNA, 523 bp, Artificial
  Synthetic oligonucleotide
ctgtctcctcagtttaagtgatcctcctgcctcagcttccccagtagctgggactacaggtgtgcaccaccatgcccggctaatttttgtatttttagtagagacagtgttcaccatgttggccaggctggtctcaaactcctgacctcaagttatccgcctgtcccagcctcccaaaggattacaggtgtaagccaccacgcccggccccagcctcccctcttgaagcctccatctctgaatcaggggaatgaatgcaggtctcttaggagcatgagtgatcacagaggacttactggaggaggcatttctgagctgggcatggaaggatgagcaggaatgtgcagagacacagatgatgggatgtggagatgataggacagaccccacctacttccccgggggattgtgaagaatgactcccagagaagtgactcattggctccaatcatttattcattcatcaaacatccgggtcacccaagaggcctcacctagtgacaccctagtcctgcagggttag

SEQ ID NO: 111 - DNA, 129 bp, Artificial
  Synthetic oligonucleotide
atcagggctgagagagtggcaaggagagggcactgaggagacactgtggaaggaggatgaagggtgttcctggcagagggatcagcctgtgtggaggtcctgagtaaagtgagatactatgggggtcag

SEQ ID NO: 112 - DNA, 249 bp, Artificial
  Synthetic oligonucleotide
aggcagtgggtctggtcttagggatgaaaccaagggagctaggaggcaggagcagcccaagccctgccttaggggcctccactcaagcatgtattgagcacctgctgtttgtgggctttgtcgcatcactgtgaagccaactgtaccctcttctcagtgacgaaacaggcttggctcagggctggtgggcgggaccgttgagataacggggaggaagctgaggcaaccccctgctccccacccacccag

SEQ ID NO: 113 - DNA, 418 bp, Artificial
  Synthetic oligonucleotide
gtaagaatctttttagccctcagcttgacactcatagtcccatggagtcagggatggacaagacagagggaccagagataaaggaacccaggcggaggttgcagtgagctgagatcatgccactgcactccagcctgggcaacaagagcaaaacttgatagctttgcatagggaaagagggcattgatgctggggttttgaaaggtgagtaggagtccatcaggcaaaaaaagtatgtattaattcgaagtattaaacatccctagccacccccattgggaaagatgtgccactgatttgcgaggcgggaggcgggggccagacttgggaatatgtgcagccctttctgggctggaaccagggtgcatgggttggggtagctgctgggaatatgcgacccctgtcttgctttgtgcag

SEQ ID NO: 114 - DNA, 293 bp, Artificial
  Synthetic oligonucleotide
aatcctgctccactaagaatggtgctaaagtaaaactagtttaataagcccttatggatggtgtaattaatttgataagtcagccattcccccttccccaggcctggcaaaacccgctctctactaaaaatacaaaaattagccaggcgcggtggcgggcgcctgtaatcccagctacttgggaggctgaggcaggagaattgcttgaacccggcaggcagaggttgcagtgagccgaaatcgcgccactgtgctccagcctgggcgacaagagcaaaattccatctcaaaat

SEQ ID NO: 115 - DNA, 1066 bp, Artificial
  Synthetic oligonucleotide
gtagggacggcgacagggcgggcaggctggagggaacaggcgccctgtcggggcacgcggctccttctttctccccagacttcacaggggaagaccagggccccgaggggacgctgtccctgccgggttcctggaaaaaccctgttcagttcccggcgctgcggccacactccctccgtgccgtttcgctttcgcatcccgcatctgagaggcgcagctgcctccacccgcctagtcccgcccaagggttcaatgagcgcctactgtgtacttttggggcaggagctggggtctccttttgtggcccagggcacaagttcagcagctggccaagggccgccggcatgcattcttgctgctacccttgatgcattcattccagccagggcagggctcgcgtgtctttgggacctattaggcagatgccctagaggctgagcgacttgctcaccgctccagcgacatgggccacccgccacccctcagctgaagccggaagtcagcacctattaggtgccgcctctattcagtcggacttggaaagggttcacgtggatcccttgctcagctcagaggcaaggtctccaggtgaagtgacaagaaatgagcatgggccaaggccggaggcggtggctcatgcctgtaatcccaacactttggaagtctgaggcaggcagatcacgaggtcaggagttcgagaccattctggcctacatggagaaaccctgtctctactaaaaatacaaaaattagctgggtgtggtggcatgtgcctataatcccagctactcaggaggctgaggcaggacaattgcttgaaccagggagtcgggtgttgcagtgagccgagatcgtgccgcagcacaccagcctagcgacagtgagactccatctcaaaaaaaaaaaaaaaagtctcaaagtcaagattccacctggcaagttctggaaggcgtgcaagatgaattgcgtatcacagccccctttctacaagactaccaagtggggttgagagaagtggggaactgcccagggctacacctgcctcccacgccttcctaatccacag

SEQ ID NO: 116 - DNA, 45 bp, Artificial
  Synthetic oligonucleotide
gtgaccctctactatgaagcactgtgcggtggctgccgagccttc

SEQ ID NO: 117 - DNA, 35 bp, Artificial
  Synthetic oligonucleotide
ctgatccgggagctcttcccaacatggctgttggt

SEQ ID NO: 118 - DNA, 46 bp, Artificial
  Synthetic oligonucleotide
catggagatcctcaatgtcacgctggtgccctacggaaacgcacag

SEQ ID NO: 119 - DNA, 39 bp, Artificial
  Synthetic oligonucleotide
gaacaaaatgtcagtggcaggtgggagttcaagtgccag

SEQ ID NO: 120 - DNA, 36 bp, Artificial
  Synthetic oligonucleotide
catggagaagaggagtgcaaattcaacaaggtggag

SEQ ID NO: 121 - DNA, 39 bp, Artificial
  Synthetic oligonucleotide
gcctgcgtgttggatgaacttgacatggagctagccttc

SEQ ID NO: 122 - DNA, 31 bp, Artificial
  Synthetic oligonucleotide
tcgccacacctttgcccctgctgcgatgacc

SEQ ID NO: 123 - DNA, 54 bp, Artificial
  Synthetic oligonucleotide
ctgaccattgtctgcatggaagagtttgaggacatggagagaagtctgccacta

SEQ ID NO: 124 - DNA, 22 bp, Artificial
  Synthetic oligonucleotide
tgcctgcagctctacgccccag

SEQ ID NO: 125 - DNA, 64 bp, Artificial
  Synthetic oligonucleotide
ggctgtcgccagacactatcatggagtgtgcaatgggggaccgcggcatgcagctcatgcacgc

SEQ ID NO: 126 - DNA, 39 bp, Artificial
  Synthetic oligonucleotide
caacgcccagcggacagatgctctccagccaccacacga

SEQ ID NO: 127 - DNA, 28 bp, Artificial
  Synthetic oligonucleotide
gtatgtgccctgggtcaccgtcaatggg

SEQ ID NO: 128 - DNA, 18 bp, Artificial
  Synthetic oligonucleotide
ctgtcgccacttctgctg

SEQ ID NO: 129 - DNA, 4 bp, Artificial
  Synthetic oligonucleotide
aaac

SEQ ID NO: 130 - DNA, 20 bp, Artificial
  Synthetic oligonucleotide
ccttggaagatcagacccag

SEQ ID NO: 131 - DNA, 30 bp, Artificial
  Synthetic oligonucleotide
ctccttacccttgtctgccagttgtaccag

SEQ ID NO: 132 - DNA, 22 bp, Artificial
  Synthetic oligonucleotide
ggcaagaagccggatgtctgcc

SEQ ID NO: 133 - DNA, 4 bp, Artificial
  Synthetic oligonucleotide
cttc

SEQ ID NO: 134 - DNA, 9 bp, Artificial
  Synthetic oligonucleotide
ctcaaccag

SEQ ID NO: 135 - DNA, 100 bp, Artificial
  Synthetic oligonucleotide
ctccctcaggagtgtttgcttcaagtgatggccggtgagctgcggagagctcatggaaggcgagtgggaacccggctgcctgcctttttttctgatccag

SEQ ID NO: 136 - DNA, 85 bp, Artificial
  Synthetic oligonucleotide
accctcggcacctgctacttaccaactggaaaattttatgcatcccatgaagcccagatacacaaaattccaccccatgatcaag

SEQ ID NO: 137 - DNA, 51 bp, Artificial
  Synthetic oligonucleotide
ttcctgccaccgctgctgctgctgctggacgtccccacggcggcggtgcag

SEQ ID NO: 138 - DNA, 36 bp, Artificial
  Synthetic oligonucleotide
gcgtcccctctgcaagcgttagacttctttgggaat

SEQ ID NO: 139 - DNA, 21 bp, Artificial
  Synthetic oligonucleotide
gggccaccagttaactacaag

SEQ ID NO: 140 - DNA, 21 bp, Artificial
  Synthetic oligonucleotide
acaggcaatctatacctgcgg

SEQ ID NO: 141 - DNA, 36 bp, Artificial
  Synthetic oligonucleotide
gggcccctgaagaagtccaatgcaccgcttgtcaat

SEQ ID NO: 142 - protein, 261 aa, Homo sapiens [sequence omitted]

SEQ ID NO: 143 - protein, 189 aa, Homo sapiens [sequence omitted]

SEQ ID NO: 144 - protein, 238 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGVRIFLALSLTLIVPWSQGWTRQRDQR

SEQ ID NO: 145 - protein, 244 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHENPWKIRPSSLPLSASCTRARSRMSALPQPAPSGVFASSDGR

SEQ ID NO: 146 - protein, 219 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVECLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 147 - protein, 133 aa, Homo sapiens
MTLSPLLLFLPPLLLLLDVPTAAVQASPLQALDFFGNGPPVNYKCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 148 - DNA, 1362 bp, Homo sapiens
ccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 149 - DNA, 1376 bp, Homo sapiens
ccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 150 - DNA, 760 bp, Artificial
  Synthetic oligonucleotide
ccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtgg

SEQ ID NO: 151 - DNA, 224 bp, Artificial
  Synthetic oligonucleotide
ggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagat

SEQ ID NO: 152 - DNA, 359 bp, Artificial
  Synthetic oligonucleotide
gttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 153 - DNA, 19 bp, Artificial
  Synthetic oligonucleotide
gtaggttcaaaaggcaaag

SEQ ID NO: 154 - DNA, 14 bp, Artificial
  Synthetic oligonucleotide
actctctgctccag

SEQ ID NO: 155 - protein, 148 aa, Homo sapiens
MRGSELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 156 - protein, 141 aa, Homo sapiens [sequence omitted]

SEQ ID NO: 157 - protein, 142 aa, Homo sapiens
MRGSELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKDSLLQVLNVKEGTPS

SEQ ID NO: 158 - DNA, 1397 bp, Homo sapiens
ggagaagcttccggactccttggggttaaaagggaaggtcccgccaggggtccctgggcagaggataccagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggccctacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtga

SEQ ID NO: 159 - DNA, 1052 bp, Homo sapiens
ggagaagcttccggactccttggggttaaaagggaaggtcccgccaggggtccctgggcagaggataccagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtga

SEQ ID NO: 160 - DNA, 935 bp, Homo sapiens
ggagaagcttccggactccttggggttaaaagggaaggtcccgccaggggtccctgggcagaggataccagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagtaggaggagatccatccccgaggacgccacggggggctgtggaggcggcctccagggaggagcgggcagggcggggtctctcggaactcccacagctggaggtgcggtccccggtgtccttccagcaggaggagagaccgggcttgcgctgtggccgccaggggacggtgtggtccttttccgcatttctgggcccgtcactcctctcccgctgattctccttgagctctaggaggaggtggttgcctgcaacggatagaagccagggtccggtgtggtcaggaatttagaactaaaggaaaaggttcacttcgtgagtccccgttgaaggaggaagggttgggtattaccacagagaaaatgtggagttgggctgggctcggtggctcacgcctgtaatcccagcactttgggaggccaaggcgggtggatcacctgaggtcaggagttcaagaccagcctggccaacatggtgaaaccacttctcaactaaaaataaaataaaataaaaaataaaa

SEQ ID NO: 161 - DNA, 1464 bp, Homo sapiens
ggcgtggctgcagccagggtagctggggcgcggagagcgctccactcgggcacagggaggacgggaagatgccgcgaggggcgtcattagggtaattgtgcccattaccgctgttccagcccgaatctcccgtctgccagcccctggggttatcggctgcaggtcaaaagggtgcttgcgggctggggtggcccaggctgggcggatgagcgcggcgaggtgggggtctctaacggagcatctgttttaacccgcccctgcacacaccccagcagatcctggccatgagagctccgcacctccacctctccgccgcctctggcgcccgggctctggcgaagctgctgccgctgctgatggcgcaactctggggccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtga

SEQ ID NO: 162 - DNA, 181 bp, Artificial
  Synthetic oligonucleotide
ccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaa

SEQ ID NO: 163 - DNA, 519 bp, Artificial
  Synthetic oligonucleotide
gtaggaggagatccatccccgaggacgccacggggggctgtggaggcggcctccagggaggagcgggcagggcggggtctctcggaactcccacagctggaggtgcggtccccggtgtccttccagcaggaggagagaccgggcttgcgctgtggccgccaggggacggtgtggtccttttccgcatttctgggcccgtcactcctctcccgctgattctccttgagctctaggaggaggtggttgcctgcaacggatagaagccagggtccggtgtggtcaggaatttagaactaaaggaaaaggttcacttcgtgagtccccgttgaaggaggaagggttgggtattaccacagagaaaatgtggagttgggctgggctcggtggctcacgcctgtaatcccagcactttgggaggccaaggcgggtggatcacctgaggtcaggagttcaagaccagcctggccaacatggtgaaaccacttctcaactaaaaataaaataaaataaaaaataaaa

SEQ ID NO: 164 - DNA, 169 bp, Artificial
  Synthetic oligonucleotide
gccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggccc

SEQ ID NO: 165 - DNA, 129 bp, Artificial
  Synthetic oligonucleotide
tacaacaagggcctgacctgctccagcatcactatcctgagccctaaagagtgtgaggtcttctaccctggcgtggtcaccaacaacatgatatgtgctggactggaccggggccaggacccttgccag

SEQ ID NO: 166 - DNA, 149 bp, Artificial
  Synthetic oligonucleotide
agtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaa

SEQ ID NO: 167 - DNA, 177 bp, Artificial
  Synthetic oligonucleotide
ctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgc

SEQ ID NO: 168 - DNA, 121 bp, Artificial
  Synthetic oligonucleotide
ctgtactgaagctgaaatgcaggaagtggtggcaaaggtttattccagagaagccaggaagccggtcatcacccagcctctgagagcagttactggggtcacccaacctgacttcctctgc

SEQ ID NO: 169 - DNA, 1753 bp, Artificial
  Synthetic oligonucleotide
cactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctcctgccttggcacgagctaggctggccctgagtcattagcaccttttctgccttcatgaggccactgaactcaagggacctcaccttgcttccatcccagcctctaagaccagagggccgagggggtagtgaagattggggaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagtctggccaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgttttttttttaatagcacctattatacctgaaattatctc

SEQ ID NO: 170 - DNA, 138 bp, Artificial
  Synthetic oligonucleotide
ggagaagcttccggactccttggggttaaaagggaaggtcccgccaggggtccctgggcagaggataccagcggcagaccacaggcagggcagaggcacgtctgggtcccctccctccttcctatcggcgactcccag

SEQ ID NO: 171 - DNA, 184 bp, Artificial
  Synthetic oligonucleotide
gtaattgtgcccattaccgctgttccagcccgaatctcccgtctgccagcccctggggttatcggctgcaggtcaaaagggtgcttgcgggctggggtggcccaggctgggcggatgagcgcggcgaggtgggggtctctaacggagcatctgttttaacccgcccctgcacacaccccagcag

SEQ ID NO: 172 - DNA, 106 bp, Artificial
  Synthetic oligonucleotide
gtagtgccggggccccgcgtccgggccctgcagcttccctaccgctgtgctcagcccggagaccagtgccaggttgctggctggggcaccacggccgcccggagag

SEQ ID NO: 173 - DNA, 5 bp, Artificial
  Synthetic oligonucleotide
tgaag

SEQ ID NO: 174 - DNA, 23 bp, Artificial
  Synthetic oligonucleotide
ctgatccagatgctacgctccag

SEQ ID NO: 175 - DNA, 91 bp, Artificial
  Synthetic oligonucleotide
ggcgtggctgcagccagggtagctggggcgcggagagcgctccactcgggcacagggaggacgggaagatgccgcgaggggcgtcattagg

SEQ ID NO: 176 - DNA, 97 bp, Artificial
  Synthetic oligonucleotide
atcctggccatgagagctccgcacctccacctctccgccgcctctggcgcccgggctctggcgaagctgctgccgctgctgatggcgcaactctggg

SEQ ID NO: 177 - protein, 276 aa, Homo sapiens
MRAPHLHLSAASGARALAKLLPLLMAQLWAAEAALLPQNDTRLDPEAYGAPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVPGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 178 - protein, 239 aa, Homo sapiens
MRAPHLHLSAASGARALAKLLPLLMAQLWAAEAALLPQNDTRLDPEAYGAPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 179 - protein, 124 aa, Homo sapiens
MRAPHLHLSAASGARALAKLLPLLMAQLWVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 180 - protein, 35 aa, Homo sapiens
MRAPHLHLSAASGARALAKLLPLLMAQLWGHCGLE

SEQ ID NO: 181 - protein, 90 aa, Homo sapiens
MRAPHLHLSAASGARALAKLLPLLMAQLWAAEAALLPQNDTRLDPEAYGAPCARGSQPWQVSLFNGLSFHCAGVLVDQSWVLTAAHCGNK

SEQ ID NO: 182 - DNA, 2546 bp, Homo sapiens
agtggggagagatgagtgtagataaaaggagtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcgctggtcctgccgctgctgtgttgagagagctgcgttgcgtttgtttacagaccacgcagggagttcatcccaaaatgatcagtaatctgcaagtgttcgccataggcccacagtgctccaaggtggaagtggtgtaagttctgtgctgctgtgtccgctgtgaccttggcaagagagaaatcccgcagcctgggtcttcaaccttggtatctcatgagtgtatcttctttttctttccttcagagcctccctgaagaacgggaaggaaatttgtcttgatccagaagccccttttctaaagaaagtcatccagaaaattttggacggtggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcactttgaagagtgtgaggaaaacctatgtttgccgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcggcagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtatgtatttatatattatatatttatatataatatatattatatatttagcattgctgagctttttagatgcctattgtgtatcttttaaaggttttgaccattttgttatgagtaattacatatatattacattcactatattaaaattgtacttttttactatgtgtctcattggtt

SEQ ID NO: 183 - DNA, 257 bp, Artificial
  Synthetic oligonucleotide
agtggggagagatgagtgtagataaaaggagtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcg

SEQ ID NO: 184 - DNA, 133 bp, Artificial
  Synthetic oligonucleotide
ctggtcctgccgctgctgtgttgagagagctgcgttgcgtttgtttacagaccacgcagggagttcatcccaaaatgatcagtaatctgcaagtgttcgccataggcccacagtgctccaaggtggaagtggt

SEQ ID NO: 185 - DNA, 1786 bp, Artificial
  Synthetic oligonucleotide
tggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcactttgaagagtgtgaggaaaacctatgtttgccgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcggcagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtat

SEQ ID NO: 186 - DNA, 153 bp, Artificial
  Synthetic oligonucleotide
atataatatatattatatatttagcattgctgagctttttagatgcctattgtgtatcttttaaaggttttgaccattttgttatgagtaattacatatatattacattcactatattaaaattgtacttttttactatgtgtctcattggtt

SEQ ID NO: 187 - DNA, 110 bp, Artificial
  Synthetic oligonucleotide
gtaagttctgtgctgctgtgtccgctgtgaccttggcaagagagaaatcccgcagcctgggtcttcaaccttggtatctcatgagtgtatcttctttttctttccttcag

SEQ ID NO: 188 - DNA, 84 bp, Artificial
  Synthetic oligonucleotide
agcctccctgaagaacgggaaggaaatttgtcttgatccagaagccccttttctaaagaaagtcatccagaaaattttggacgg

SEQ ID NO: 189 - DNA, 23 bp, Artificial
  Synthetic oligonucleotide
gtatttatatattatatatttat

SEQ ID NO: 190 - protein, 114 aa, Homo sapiens
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 191 - protein, 81 aa, Homo sapiens
MSLLSSRAARVPGPSSSLCALLVLLLLLTQPGPIASAGPAAAVLRELRCVCLQTTQGVHPKMISNLQVFAIGPQCSKVEVV

SEQ ID NO: 192 - DNA, 751 bp, Homo sapiens
ccagaaacatccagaatacatttccaacaagagcactggccaagtcagcttcttctgagagagtctctagaagacatgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctataagaaatttggatacagagacatgcatacagaaggaatgccatgtgagcaggaagcagagtgtgatcgtgcagcagaagccaaggaatgctcaaggttgtcagcaaacacactggatgacaggcacggaaaagattctccttcacagccctcggaaggaaccaaccctgccaacaccttgatctcagatctctaccctccagatctgtgagacaataaattgact

SEQ ID NO: 193 - DNA, 1526 bp, Homo sapiens
ccagaaacatccagaatacatttccaacaagagcactggccaagtcagcttcttctgagagagtctctagaagacatgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtaggtatgtatgtgatctcatttcatcagatctacaaaattagtagaaatcagcattcttgcttttatttttaaatgctagttcaagtactattctttttaaagagaagtcatttctaatccaataatatcagctcttgttagttctacaatcaaaatccactatatctgtaatttgaaaattttaaatattttttcaaagcatgtatgctattaaatctatatcccaatgtactttcaacacagtgccccagactagattgacagagacctatgacacactaaaaggagaattcaggttaattcatgaactgacatgtatgaaaactaattttgcttataaattggtttgacatttgttttagattaagaaacaaaaatgattttaagaacgttttatggatgtagccagaggccattatcctaagcaaatgaacacagaaacagaaaaccaaatagtgaatgttcacacatataaatatgagctaaacactggttacacatggacataaagagaggaaaaatagacaataggaactccaaaacgggggaaggagggagggagccaaaggatgaaaaactaactgttggctactatgttcactattagggtgttgggttcagctgaagcccaaacttcagcatcacacaatatatctgtgtaacaaacttgtacacataacccccacatataaaataataattaagtttttacaagagtaaagaaaagaacatgctaaattatactttcgtgacttggttttttccttgacagacccttctttaacagttagagctgacatagctggaagatactctaacagattgtacacatatgagcctcgggatttacccctattgatagaaaacatgaagaaagcattaagacttattcagtcagagctataagagatgatagaaaaaagccttcacttcaaagaagtcaaatttcatgaagaaaacctctggcacattgacaaatactaaatgtgcaagtatatagattttgtaatattactatttagtttttttaatgtgtttgcaatagtcttattaaaataaatgttttttaaatctgagactgacaa

SEQ ID NO: 194 - DNA, 361 bp, Artificial
  Synthetic oligonucleotide
gtatgtatgtgatctcatttcatcagatctacaaaattagtagaaatcagcattcttgcttttatttttaaatgctagttcaagtactattctttttaaagagaagtcatttctaatccaataatatcagctcttgttagttctacaatcaaaatccactatatctgtaatttgaaaattttaaatattttttcaaagcatgtatgctattaaatctatatcccaatgtactttcaacacagtgccccagactagattgacagagacctatgacacactaaaaggagaattcaggttaattcatgaactgacatgtatgaaaactaattttgcttataaattggtttgacatttgttttag

SEQ ID NO: 195 - DNA, 410 bp, Artificial
  Synthetic oligonucleotide
attaagaaacaaaaatgattttaagaacgttttatggatgtagccagaggccattatcctaagcaaatgaacacagaaacagaaaaccaaatagtgaatgttcacacatataaatatgagctaaacactggttacacatggacataaagagaggaaaaatagacaataggaactccaaaacgggggaaggagggagggagccaaaggatgaaaaactaactgttggctactatgttcactattagggtgttgggttcagctgaagcccaaacttcagcatcacacaatatatctgtgtaacaaacttgtacacataacccccacatataaaataataattaagtttttacaagagtaaagaaaagaacatgctaaattatactttcgtgacttggttttttccttgacag

SEQ ID NO: 196 - DNA, 136 bp, Artificial
  Synthetic oligonucleotide
cttcttctgagagagtctctagaagacatgatgctacactcagctttgggtctctgcctcttactcgtcacagtttcttccaaccttgccattgcaataaaaaaggaaaagaggcctcctcagacactctcaagag

SEQ ID NO: 197 - DNA, 229 bp, Artificial
  Synthetic oligonucleotide
tgatagaaaacatgaagaaagcattaagacttattcagtcagagctataagagatgatagaaaaaagccttcacttcaaagaagtcaaatttcatgaagaaaacctctggcacattgacaaatactaaatgtgcaagtatatagattttgtaatattactatttagtttttttaatgtgtttgcaatagtcttattaaaataaatgttttttaaatctgagactgacaa

SEQ ID NO: 198 - DNA, 225 bp, Artificial
  Synthetic oligonucleotide
aagaaatttggatacagagacatgcatacagaaggaatgccatgtgagcaggaagcagagtgtgatcgtgcagcagaagccaaggaatgctcaaggttgtcagcaaacacactggatgacaggcacggaaaagattctccttcacagccctcggaaggaaccaaccctgccaacaccttgatctcagatctctaccctccagatctgtgagacaataaattgact

SEQ ID NO: 199 - DNA, 48 bp, Artificial
  Synthetic oligonucleotide
ccagaaacatccagaatacatttccaacaagagcactggccaagtcag

SEQ ID NO: 200 - DNA, 77 bp, Artificial
  Synthetic oligonucleotide
cactaaagaaagtatttgcccaaaatgaagaaatacaagaaatggctcagaataagttcatcatgctaaaccttatg

SEQ ID NO: 201 - DNA, 64 bp, Artificial
  Synthetic oligonucleotide
catgaaaccactgataagaatttatcacctgatgggcaatatgtgcctagaatcatgtttgtag

SEQ ID NO: 202 - DNA, 84 bp, Artificial
  Synthetic oligonucleotide
acccttctttaacagttagagctgacatagctggaagatactctaacagattgtacacatatgagcctcgggatttacccctat

SEQ ID NO: 203 - DNA, 64 bp, Artificial
  Synthetic oligonucleotide
gatggggagatgacatcacttgggtacaaacttatgaagaaggtctcttttatgctcaaaaaag

SEQ ID NO: 204 - DNA, 4 bp, Artificial
  Synthetic oligonucleotide
taag

SEQ ID NO: 205 - DNA, 49 bp, Artificial
  Synthetic oligonucleotide
aagccattaatggttattcatcacctggaggattgtcaatactctcaag

SEQ ID NO: 206 - protein, 150 aa, Homo sapiens
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPL

SEQ ID NO: 207 - protein, 145 aa, Homo sapiens
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVGMYVISFHQIYKISRNQHSCFYF

SEQ ID NO: 208 - DNA, 4902 bp, Homo sapiens
ccttgctgttcatggcccagcaggggccctatgggggtcaggcctgcaggcactcacacttggcacctgctccaaaaccctttcaggtctttgaggatctgagccctgggcctgggtctcccgccggctcggaaaagctggcctgccgggccagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcaggtacgccccgcctctactcaccttccttcccaccagacccagctgtggctctcaggatgggaagggacccccccaccaggtcatctagccccatctaatatgtgaacacccaccacaacatccacagcaaacagatactcagacaatgcttacatacccccagggacaaggaactcaccacttaccaaagctagctatccatctcttgtccatttgcaagcatggcaggtttgtcattttgtaaactaaagtctgtctcactctaatatttgcattataatcttaattcctctttttatttcagttacgtaagttgttaaatggcagagtgagcactggcatggctgccaggggagctctgaggacttcagtggggtgaaatgtgaccacttaggtgactgtgtatgttggctataaaactgcgctataaaaccatgaggtgctgaggatgatccttgccagaaacatgttttcttctccaaggtgccccactccctctgctgcccagaaacctgataaactccttccttcgcaggtgctggaaggcaccacaggtttggctctttaaaatcagagccactgttaaccaaggcgggcagcagtgttaagaccaccagcaccctgaaccagccctgtacttactgggcactgtttccttaaaatcagaaggtggcttcccatctctggtttcctggggtcttatgtctgtcctcggagggagaatccagttcctagctcccctgtaccatgcgaaggtagcctgtcctgtctcactcctcagatacgcagagtctgtttacacatttgcctgcatagcatgatcaggaagcacacacacacacacacacacacacacacacgcatgcatgcacacaccatgcaggtgacttccccaggaactagtgccagcacccctgctgcagagggggatatcaaggctaaatggaagagaggggtgacttgcctgggagcacagggcaaagccaggacagcaaaccaggcctcctggtgctaccccaccagctgccctcacagggtggaaggtacagccatagtgggtgcctgcattgccctcccctcacctggcccagccatgctaccccaagctcagccctgtgaccagctctcccagagctgacactcgggctcaacccctatacctgagccttttttgctgcctccaaaacagcctcatctgcagttgcttgaaatagaaagtgatgagagcaataaattattttctataaatctgctgggaatgaagccctctttctggtcaagccaggcagctcatgtggcaaaggccagaactgcgcagtccacactctgtcaccctccaggccctgtgtcatcaaaactggcagaaggctaatcccatgggcaggttatggaagaggctgagggcatcttgatctgattgctgggggatactcaaacctttagctcaccttgcttctcccctccacctgagctgcagcctggaaaaggaggcacccacaggtctaaacatggccctgcttttttttttcctgaaaattccaataacaaaagcaacgagagcctctcactaccaggccttctctcactttgctataaaattagttcacccctctttcttagagtgttgaggtccctgccctccccacctccctcccctgaaacaagttgaaaatatcttaatgaacatagaacagtgataaaggaagtgtttgaagtcctctttgtacagagagagagagaaagagaatgccaaagctaggttggaggaagtagaagggtatacggtgggctcaggcccatgggggccacacagaggagctctgtgcacttcagagaccagagcttccagggagcttctggccaccacaggaagcagcctagtcaggcattttatttcaatggataattcagtggtcttactcagaaatcaagaacgagacagaaaagtgataggctaagtgtaacgtatggccccagggcagccatggggcagaactagaagaaagcaaaatatctaactgggcacagcttgagaggtgaggggaaggtggggctgggaacgagtagagatgaggcaatgcagccaggagcagggactgaggggcacaggcctcctgcaccactgccccaccccaccaaccacctcttctgtctccaggaagcagcttctagagctagcattcttctggaggacatgcattatttgggcaaaatacaaagaaatatacaagcctaagtcaagtaagggaatgcctcccacccttgctattttctctaaatagagaggctgagtacagacgcggaaagaaacaaggaggtgtgggagcagcccgccatgctagagaaagactacattcctgccactaacagtcggtggccactgggcaaatcttaagtctgtggtgcctcagtttcctcatatgcaaagcgggtttgttccataggcctctgaggacaaaatgagattgcagaagtgagattgcagatggttagaaaagacaaagccacactggtgtgagttttcatggtccccgggaccacatcctcagaaggatccctcccacttctcctgggggttcctgcagttctgggacaggggcattccctgcagaccagacgtgaatgaagccgcttagccagcatcttgtgaacggcctgcctcatgtcctgagccacttacacatgtgttttttctccccagggtctacgaagaatagggtgaaaaacctcagaagggaaaactccaaaccagttgggagacttgtgcaaaggactttgcagattaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtaccaaaattctaga

SEQ ID NO: 209 - DNA, 616 bp, Artificial
  Synthetic oligonucleotide
ccttgctgttcatggcccagcaggggccctatgggggtcaggcctgcaggcactcacacttggcacctgctccaaaaccctttcaggtctttgaggatctgagccctgggcctgggtctcccgccggctcggaaaagctggcctgccgggccagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccag

SEQ ID NO: 210 - DNA, 1062 bp, Artificial
  Synthetic oligonucleotide
gtacgccccgcctctactcaccttccttcccaccagacccagctgtggctctcaggatgggaagggacccccccaccaggtcatctagccccatctaatatgtgaacacccaccacaacatccacagcaaacagatactcagacaatgcttacatacccccagggacaaggaactcaccacttaccaaagctagctatccatctcttgtccatttgcaagcatggcaggtttgtcattttgtaaactaaagtctgtctcactctaatatttgcattataatcttaattcctctttttatttcagttacgtaagttgttaaatggcagagtgagcactggcatggctgccaggggagctctgaggacttcagtggggtgaaatgtgaccacttaggtgactgtgtatgttggctataaaactgcgctataaaaccatgaggtgctgaggatgatccttgccagaaacatgttttcttctccaaggtgccccactccctctgctgcccagaaacctgataaactccttccttcgcaggtgctggaaggcaccacaggtttggctctttaaaatcagagccactgttaaccaaggcgggcagcagtgttaagaccaccagcaccctgaaccagccctgtacttactgggcactgtttccttaaaatcagaaggtggcttcccatctctggtttcctggggtcttatgtctgtcctcggagggagaatccagttcctagctcccctgtaccatgcgaaggtagcctgtcctgtctcactcctcagatacgcagagtctgtttacacatttgcctgcatagcatgatcaggaagcacacacacacacacacacacacacacacacgcatgcatgcacacaccatgcaggtgacttccccaggaactagtgccagcacccctgctgcagagggggatatcaaggctaaatggaagagaggggtgacttgcctgggagcacagggcaaagccaggacagcaaaccaggcctcctggtgctaccccaccagctgccctcacagggtggaaggtacagccatagtgggtgc

SEQ ID NO: 211 - DNA, 261 bp, Artificial
  Synthetic oligonucleotide
ctgcattgccctcccctcacctggcccagccatgctaccccaagctcagccctgtgaccagctctcccagagctgacactcgggctcaacccctatacctgagccttttttgctgcctccaaaacagcctcatctgcagttgcttgaaatagaaagtgatgagagcaataaattattttctataaatctgctgggaatgaagccctctttctggtcaagccaggcagctcatgtggcaaaggccagaactgcgcagtccac

SEQ ID NO: 212 - DNA, 1361 bp, Artificial
  Synthetic oligonucleotide
gccctgtgtcatcaaaactggcagaaggctaatcccatgggcaggttatggaagaggctgagggcatcttgatctgattgctgggggatactcaaacctttagctcaccttgcttctcccctccacctgagctgcagcctggaaaaggaggcacccacaggtctaaacatggccctgcttttttttttcctgaaaattccaataacaaaagcaacgagagcctctcactaccaggccttctctcactttgctataaaattagttcacccctctttcttagagtgttgaggtccctgccctccccacctccctcccctgaaacaagttgaaaatatcttaatgaacatagaacagtgataaaggaagtgtttgaagtcctctttgtacagagagagagagaaagagaatgccaaagctaggttggaggaagtagaagggtatacggtgggctcaggcccatgggggccacacagaggagctctgtgcacttcagagaccagagcttccagggagcttctggccaccacaggaagcagcctagtcaggcattttatttcaatggataattcagtggtcttactcagaaatcaagaacgagacagaaaagtgataggctaagtgtaacgtatggccccagggcagccatggggcagaactagaagaaagcaaaatatctaactgggcacagcttgagaggtgaggggaaggtggggctgggaacgagtagagatgaggcaatgcagccaggagcagggactgaggggcacaggcctcctgcaccactgccccaccccaccaaccacctcttctgtctccaggaagcagcttctagagctagcattcttctggaggacatgcattatttgggcaaaatacaaagaaatatacaagcctaagtcaagtaagggaatgcctcccacccttgctattttctctaaatagagaggctgagtacagacgcggaaagaaacaaggaggtgtgggagcagcccgccatgctagagaaagactacattcctgccactaacagtcggtggccactgggcaaatcttaagtctgtggtgcctcagtttcctcatatgcaaagcgggtttgttccataggcctctgaggacaaaatgagattgcagaagtgagattgcagatggttagaaaagacaaagccacactggtgtgagttttcatggtccccgggaccacatcctcagaaggatccctcccacttctcctgggggttcctgcagttctgggacaggggcattccctgcagaccagacgtgaatgaagccgcttagccagcatcttgtgaacggcctgcctcatgtcctgagccacttacacatgtgttttttctccccag

SEQ ID NO: 213 - DNA, 569 bp, Artificial
  Synthetic oligonucleotide
atgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaac

SEQ ID NO: 214 - DNA, 163 bp, Artificial
  Synthetic oligonucleotide
caatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttat

SEQ ID NO: 215 - DNA, 81 bp, Artificial
  Synthetic oligonucleotide
cagagccggaaggcgcgccccgggcagagaaagccgagcagagctgggtggcgtctccgggccgccgctccgacgggccag

SEQ ID NO: 216 - DNA, 56 bp, Artificial
  Synthetic oligonucleotide
ctgcagagcaccaagcgcttcatcaagtggtacaacgcctggaacgagaagcgcag

SEQ ID NO: 217 - DNA, 17 bp, Artificial
  Synthetic oligonucleotide
actctgtcaccctccag

SEQ ID NO: 218 - DNA, 81 bp, Artificial
  Synthetic oligonucleotide
ggtctacgaagaatagggtgaaaaacctcagaagggaaaactccaaaccagttgggagacttgtgcaaaggactttgcaga

SEQ ID NO: 219 - DNA, 20 bp, Artificial
  Synthetic oligonucleotide
ttaaaaaaaaaaaaaaaaaa

SEQ ID NO: 220 - DNA, 108 bp, Artificial
  Synthetic oligonucleotide
aagcctttctttctcacaggcataagacacaaattatatattgttatgaagcactttttaccaacggtcagtttttacattttatagctgcgtgcgaaaggcttccag

SEQ ID NO: 221 - DNA, 40 bp, Artificial
  Synthetic oligonucleotide
cgccctccccatgtccctgctcccacgccgcgcccctccg

SEQ ID NO: 222 - DNA, 23 bp, Artificial
  Synthetic oligonucleotide
cttaggagaaaacttaaaaatat

SEQ ID NO: 223 - DNA, 53 bp, Artificial
  Synthetic oligonucleotide
atgaatacatgcgcaatacacagctacagacacacattctgttgacaagggaa

SEQ ID NO: 224 - DNA, 54 bp, Artificial
  Synthetic oligonucleotide
aaccttcaaagcatgtttctttccctcaccacaacagaacatgcagtactaaag

SEQ ID NO: 225 - DNA, 103 bp, Artificial
  Synthetic oligonucleotide
atgctatgtacatgtcagaaaccattagcattgcatgcaggtttcatattctttctaagatggaaagtaataaaatatatttgaaatgtaccaaaattctaga

SEQ ID NO: 226 - DNA, 36 bp, Artificial
  Synthetic oligonucleotide
gtcagcatgaggctcctggcggccgcgctgctcctg

SEQ ID NO: 227 - DNA, 34 bp, Artificial
  Synthetic oligonucleotide
ctgctgctggcgctgtacaccgcgcgtgtggacg

SEQ ID NO: 228 - DNA, 106 bp, Artificial
  Synthetic oligonucleotide
ggtccaaatgcaagtgctcccggaagggacccaagatccgctacagcgacgtgaagaagctggaaatgaagccaaagtacccgcactgcgaggagaagatggttat

SEQ ID NO: 229 - DNA, 58 bp, Artificial
  Synthetic oligonucleotide
catcaccaccaagagcgtgtccaggtaccgaggtcaggagcactgcctgcaccccaag

SEQ ID NO: 230 - protein, 99 aa, Homo sapiens
MRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 231 - protein, 123 aa, Homo sapiens
MRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRYAPPLLTFLPTRPSCGSQDGKGPPHQVI

SEQ ID NO: 232 - DNA, 2875 bp, Homo sapiens
tctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccagaccagcccaatggcgtgatcctggactatgagctgcagtactatgagaaggtacctattggctgggtgctgtccccatcacccacctccctgagggcccctctcccaggctgaggcctgggagttctgccccaccgcaagatgagacgcactggtgcagcagaaagagcactggccttggagtcaggctgcctggctcccaatccagctccgctccttcccactgtgagacctcaggcaggtgccttgacctctctggatctcacttttctggtctggaggatacacccagcaatctcagtgaaatgcaacagtcacatccctttccctaccacgaccctttcatcttgacctcagtggcttgatgttgggaaaaactgggtttccaaaaagctgcacttatgaagtgataattagtcactcacctcttcttcgacagagatttgaaacagctcaagagagcttccgcctgccctgctctgagtcctgctaaaacacccactttcactcgcctgcatgccctttgcatggggagaggtgatttcactttgagcttttaaatcagaccttaattactccctttgggtggaagcccctgggatggtagaaggatcactggactaagagtgagaagccgtaggttcaaatcccagctccgtccttcaccagctatgtgaccttgggcaggcgtctttctccctctgaacctcagtttccacctgtgtcgagtgtgggtgagacccctcgcggggagctatgcaggttacggagaaaaggcagcacagcacccagaatgggacctggccctcagcagaggccatgtgtgtccctggccttcctcctctgccctgcctgctgcacagtgggcaatggtgacaggatgggaggccaagtggatgtggggtctgcacagtacaggggccaggaggtagacagcacaattgcccacccacatggctggacatcagaggccccaggaagcctctcctttgaatgatcacttctcttacctgctccaggaggcaacaaacagccacagaggctgcaagggcacctgggaaaggcatcgcggggcttccattcagactaggtgtcaatgactgacagggaggcctttggttgagggcaagcccacggggaactgcagatggatggaagggctctccctgaaggctgagaggaagagtgcagtcaattgcagccagtcctgctggagcccaactttctagagcccagcccggccttcccactctgttaactgctggatcggctaaccaggccggtctccagggcctttcaaacacttacccagcctttgccggccgtcttaccattgcttgcgtgcgtgttcatccc

SEQ ID NO: 233 - DNA, 1182 bp, Homo sapiens
tctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgagagagacaggatctcactatgttgtccaggctggtcttgaactcgtggccacaaatgatcctcccacctcagcctcccaaagtgttggaattataggcatgaaccaccatgcccaggaggagaatttttgataataatattttgtggacatctttgcatatcatgtcagagctataacatcattgtggagaagctcttaggatcccatagaataaatgtaccgtaattta

SEQ ID NO: 234 - DNA, 203 bp, Artificial
  Synthetic oligonucleotide
tctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaag

SEQ ID NO: 235 - DNA, 229 bp, Artificial
  Synthetic oligonucleotide
agagacaggatctcactatgttgtccaggctggtcttgaactcgtggccacaaatgatcctcccacctcagcctcccaaagtgttggaattataggcatgaaccaccatgcccaggaggagaatttttgataataatattttgtggacatctttgcatatcatgtcagagctataacatcattgtggagaagctcttaggatcccatagaataaatgtaccgtaattta

SEQ ID NO: 236 - DNA, 336 bp, Artificial
  Synthetic oligonucleotide
ccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcag

SEQ ID NO: 237 - DNA, 125 bp, Artificial
  Synthetic oligonucleotide
ctccatcggcagtgtccatcatgcatcaggtgagccgcaccgtggacagcattaccctgtcgtggtcccagccagaccagcccaatggcgtgatcctggactatgagctgcagtactatgagaag

SEQ ID NO: 238 - DNA, 1305 bp, Artificial
  Synthetic oligonucleotide
gtacctattggctgggtgctgtccccatcacccacctccctgagggcccctctcccaggctgaggcctgggagttctgccccaccgcaagatgagacgcactggtgcagcagaaagagcactggccttggagtcaggctgcctggctcccaatccagctccgctccttcccactgtgagacctcaggcaggtgccttgacctctctggatctcacttttctggtctggaggatacacccagcaatctcagtgaaatgcaacagtcacatccctttccctaccacgaccctttcatcttgacctcagtggcttgatgttgggaaaaactgggtttccaaaaagctgcacttatgaagtgataattagtcactcacctcttcttcgacagagatttgaaacagctcaagagagcttccgcctgccctgctctgagtcctgctaaaacacccactttcactcgcctgcatgccctttgcatggggagaggtgatttcactttgagcttttaaatcagaccttaattactccctttgggtggaagcccctgggatggtagaaggatcactggactaagagtgagaagccgtaggttcaaatcccagctccgtccttcaccagctatgtgaccttgggcaggcgtctttctccctctgaacctcagtttccacctgtgtcgagtgtgggtgagacccctcgcggggagctatgcaggttacggagaaaaggcagcacagcacccagaatgggacctggccctcagcagaggccatgtgtgtccctggccttcctcctctgccctgcctgctgcacagtgggcaatggtgacaggatgggaggccaagtggatgtggggtctgcacagtacaggggccaggaggtagacagcacaattgcccacccacatggctggacatcagaggccccaggaagcctctcctttgaatgatcacttctcttacctgctccaggaggcaacaaacagccacagaggctgcaagggcacctgggaaaggcatcgcggggcttccattcagactaggtgtcaatgactgacagggaggcctttggttgagggcaagcccacggggaactgcagatggatggaagggctctccctgaaggctgagaggaagagtgcagtcaattgcagccagtcctgctggagcccaactttctagagcccagcccggccttcccactctgttaactgctggatcggctaaccaggccggtctccagggcctttcaaacacttacccagcctttgccggccgtcttaccattgcttgcgtgcgtgttcatccc

SEQ ID NO: 239 - DNA, 404 bp, Artificial
  Synthetic oligonucleotide
tgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggc

SEQ ID NO: 240 - DNA, 184 bp, Artificial
  Synthetic oligonucleotide
cttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaag

SEQ ID NO: 241 - DNA, 97 bp, Artificial
  Synthetic oligonucleotide
ctctactgtaacggggacggcgagtggctggtgcccatcgggcgctgcatgtgcaaagcaggcttcgaggccgttgagaatggcaccgtctgccgag

SEQ ID NO: 242 - DNA, 91 bp, Artificial
  Synthetic oligonucleotide
gttgtccatctgggactttcaaggccaaccaaggggatgaggcctgtacccactgtcccatcaacagccggaccacttctgaaggggccac

SEQ ID NO: 243 - DNA, 65 bp, Artificial
  Synthetic oligonucleotide
caactgtgtctgccgcaatggctactacagagcagacctggaccccctggacatgccctgcacaa

SEQ ID NO: 244 - DNA, 65 bp, Artificial
  Synthetic oligonucleotide
aaacgctaatggactccactacagcgactgctgagctgggctggatggtgcatcctccatcaggg

SEQ ID NO: 245 - protein, 1055 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRLGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 246 - protein, 496 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKVPIGWVLSPSPTSLRAPLPG

SEQ ID NO: 247 - protein, 301 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRERQDLTMLSRLVLNSWPQMILPPQPPKVLEL

SEQ ID NO: 248 - DNA, 3194 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 249 - DNA, 2705 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagagctgggatttccatcctcaactggcagagatgagagcctggagcattgcagatgccagggacttcacaaatgaaggcacagcatgggaaacctgcgtgggttccagggcagtccagcctgcaggggcccagggagtggtcagtaggcatttgtcacagccaaatgccagtggaaggagcagccgcccaggcagccctctactgatgagagtaacctcacccgtgcactagtttacagagcattcactgccccagcttatcccaggcctcccgcttccctctgcgggtggggtgctgagcaggcattattggcctgcatgttttactgatgaggaaactgaggctgggagagtctgtggtaggggtcaagcaggtccacagtggcggggcatggcagtggtggctgggcaggtccttgcagccttccctctccggcaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 250 - DNA, 3332 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagagctgggatttccatcctcaactggcagagatgagagcctggagcattgcagatgccagggacttcacaaatgaaggcacagcatgggaaacctgcgtgggttccagggcagtccagcctgcaggggcccagggagtggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 251 - DNA, 3052 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 252 - DNA, 2359 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggaggtgaggccctgcctgccagtccccctactcctctgctggccactgtgactgcagcatatgccctcagcatgtgtccctctctcccaccccagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 253 - DNA, 2077 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 254 - DNA, 131 bp, Artificial
  Synthetic oligonucleotide
caagcccagcagccccggggcggatggctccggccgcctggctccgcagcgcggccgcgcgcgccctcctgcccccgatgctgctgctgctgctccagccgccgccgctgctggcccgggctctgccgccg

SEQ ID NO: 255 - DNA, 182 bp, Artificial
  Synthetic oligonucleotide
gacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagag

SEQ ID NO: 256 - DNA, 144 bp, Artificial
  Synthetic oligonucleotide
gatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccag

SEQ ID NO: 257 - DNA, 134 bp, Artificial
  Synthetic oligonucleotide
gtactggcatggggacgacctgccgtttgatgggcctgggggcatcctggcccatgccttcttccccaagactcaccgagaaggggatgtccacttcgactatgatgagacctggactatcggggatgaccagg

SEQ ID NO: 258 - DNA, 183 bp, Artificial
  Synthetic oligonucleotide
acaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggag

SEQ ID NO: 259 - DNA, 217 bp, Artificial
  Synthetic oligonucleotide
ccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaag

SEQ ID NO: 260 - DNA, 138 bp, Artificial
  Synthetic oligonucleotide
agctgggatttccatcctcaactggcagagatgagagcctggagcattgcagatgccagggacttcacaaatgaaggcacagcatgggaaacctgcgtgggttccagggcagtccagcctgcaggggcccagggagtg

SEQ ID NO: 261 - DNA, 300 bp, Artificial
  Synthetic oligonucleotide
gtcagtaggcatttgtcacagccaaatgccagtggaaggagcagccgcccaggcagccctctactgatgagagtaacctcacccgtgcactagtttacagagcattcactgccccagcttatcccaggcctcccgcttccctctgcgggtggggtgctgagcaggcattattggcctgcatgttttactgatgaggaaactgaggctgggagagtctgtggtaggggtcaagcaggtccacagtggcggggcatggcagtggtggctgggcaggtccttgcagccttccctctccggcag

SEQ ID NO: 262 - DNA, 142 bp, Artificial
  Synthetic oligonucleotide
gtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcag

SEQ ID NO: 263 - DNA, 927 bp, Artificial
  Synthetic oligonucleotide
gtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcag

SEQ ID NO: 264 - DNA, 911 bp, Artificial
  Synthetic oligonucleotide
gctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 265 - DNA, 48 bp, Artificial
  Synthetic oligonucleotide
gttcgtgctttctggcgggcgctgggagaagacggacctcacctacag

SEQ ID NO: 266 - DNA, 41 bp, Artificial
  Synthetic oligonucleotide
gcacagacctgctgcaggtggcagcccatgaatttggccac

SEQ ID NO: 267 - DNA, 18 bp, Artificial
  Synthetic oligonucleotide
gtgctggggctgcagcac

SEQ ID NO: 268 - DNA, 92 bp, Artificial
  Synthetic oligonucleotide
gtgaggccctgcctgccagtccccctactcctctgctggccactgtgactgcagcatatgccctcagcatgtgtccctctctcccaccccag

SEQ ID NO: 269 - DNA, 116 bp, Artificial
  Synthetic oligonucleotide
ggactactggcgtttccaccccagcacccggcgtgtagacagtcccgtgccccgcagggccactgactggagaggggtgccctctgagatcgacgctgccttccaggatgctgatg

SEQ ID NO: 270 - protein, 488 aa, Homo sapiens [sequence omitted]

SEQ ID NO: 271 - protein, 496 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGALGVRQLVGGGHSSRFSHLVVAGLPHACHRKSGSSSQVLCPEPSALLSVAG

SEQ ID NO: 272 - protein, 382 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQELGFPSSTGRDESLEHCRCQGLHK

SEQ ID NO: 273 - protein, 370 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGTTGVSTPAPGV

SEQ ID NO: 274 - protein, 301 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEVRPCLPVPLLLCWPL

SEQ ID NO: 275 - protein, 354 aa, Homo sapiens [sequence omitted]

SEQ ID NO: 276 - DNA, 657 bp, Homo sapiens
catcgggaatcaacctacagaggccagagtgtcttgacagcacaccagagaaatccagggacctgaccgaagatgctgaatgtctccggcctctttgttctcctctgtgggctgcttgtctcatcctctgcacaggaggtcctggctggagtttcttcccagctccttaatggtgagactgtcctgctttgggtcatgcagaaccctgagccaatgccagttaagttctcattagcaaagtacctgggacacaatgaacactattaattattagccgtcctgactgcaacatcgtttaatcctcattttccgagcaccccctctttcctgtctccttgctgtgctttatctatcaagacccaccatcaaaggaaccagctctatatggactggtccctgtcgcagcctttgtacctgctgtttcctctgcctgggacactcttcccctacctgtcaacctagctgcctcccttccttcaggtctctgctcaaatgccacatttgcagaaagcccttccttgacctcctgcgtaaatgaatccctcaccctgccttttgttttttcatcataggatggactgatatctagcggcatggtcatcgtggttaaaacattgaaattttggggtatactatttgtgaagtatttcctgctta

SEQ ID NO: 277 - DNA, 485 bp, Artificial
  Synthetic oligonucleotide
gtgagactgtcctgctttgggtcatgcagaaccctgagccaatgccagttaagttctcattagcaaagtacctgggacacaatgaacactattaattattagccgtcctgactgcaacatcgtttaatcctcattttccgagcaccccctctttcctgtctccttgctgtgctttatctatcaagacccaccatcaaaggaaccagctctatatggactggtccctgtcgcagcctttgtacctgctgtttcctctgcctgggacactcttcccctacctgtcaacctagctgcctcccttccttcaggtctctgctcaaatgccacatttgcagaaagcccttccttgacctcctgcgtaaatgaatccctcaccctgccttttgttttttcatcataggatggactgatatctagcggcatggtcatcgtggttaaaacattgaaattttggggtatactatttgtgaagtatttcctgctta

SEQ ID NO: 278 - DNA, 58 bp, Artificial
  Synthetic oligonucleotide
catcgggaatcaacctacagaggccagagtgtcttgacagcacaccagagaaatccag

SEQ ID NO: 279 - DNA, 114 bp, Artificial
  Synthetic oligonucleotide
ggacctgaccgaagatgctgaatgtctccggcctctttgttctcctctgtgggctgcttgtctcatcctctgcacaggaggtcctggctggagtttcttcccagctccttaatg

SEQ ID NO: 280 - protein, 179 aa, Homo sapiens
MLNVSGLFVLLCGLLVSSSAQEVLAGVSSQLLNDLTQGLLRADFLPSLQTTGLQKPLSSAFDGVSGLLDIFGPPLTNEINTVSIQVKNPQLLHVSIESTPQRKEATVQVPFTSELIVQLLTMKPFTANMQSDIKVQIRLEKNVGGRYELAFGNCRLLPEAIWIQTGVQLAPAQNLLWQT

SEQ ID NO: 281 - protein, 64 aa, Homo sapiens [sequence omitted]

SEQ ID NO: 282 - DNA, 527 bp, Homo sapiens
cagcgccttgccttctcttaggctttgaagcatttttgtctgtgctccctgatcttcaggtcaccaccatgaagttcttagcagtcctggtactcttgggagtttccatctttctggtctctgcccagaatccgacaacagctgctccagctgacacgtatccagctactggtcctgctgatgatgaagcccctgatgctgaaaccactgctgctgcaaccactgcgaccactgctgctcctaccactgcaaccaccgctgcttctaccactgctcgtaaagacattccagccccttgacaatatttttttctcttgcagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacaaaaaaatggtat

SEQ ID NO: 283 - DNA, 646 bp, Homo sapiens
cacttttgatcttcccttcagcgaccttgaagcctttgatatatcccccttttaactctaccaccttcatccctctgttcattctgccaggcttttcatttcccacttcaacctctcagctcccaacagtcacttgaactatagaccccttggcctccattgggggctctccttaagagactgagggatccctgagggatccccaaaagcaatgattagaggctgaaaacagaaaaaaaactttggaaacagactggatgttttgtacactcagagaatccgacaacagctgctccagctgacacgtatccagctactggtcctgctgatgatgaagcccctgatgctgaaaccactgctgctgcaaccactgcgaccactgctgctcctaccactgcaaccaccgctgcttctaccactgctcgtaaagacattccagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacaaaaaaatggtat

SEQ ID NO: 284 - DNA, 491 bp, Homo sapiens
cagcgccttgccttctcttaggctttgaagcatttttgtctgtgctccctgatcttcaggtcaccaccatgaagttcttagcagtcctggtactcttgggagtttccatctttctggtctctgcccagaatccgacaacagctgctccagctgacacgtatccagctagtgagtctgcacttgaatgtcatctctttccagcaataaccatttttcacttccagcctcatgtcaaacagccagtttccatgtggatagtctttgttataaggaatcctaagcaaaagtctgtgaaagctatattcctgattttaaaattcaccacaaacatagtgaatctgcttatttcttatacattcttagaatatatgaaatctaggccatagacttatacaaatgtggacttattattcattgttttccagcataaggcacaagagcatgaggtctgatgttgtagcctgagaatttttgagagatgcctctaataa

SEQ ID NO: 285 - DNA, 274 bp, Artificial
  Synthetic oligonucleotide
cacttttgatcttcccttcagcgaccttgaagcctttgatatatcccccttttaactctaccaccttcatccctctgttcattctgccaggcttttcatttcccacttcaacctctcagctcccaacagtcacttgaactatagaccccttggcctccattgggggctctccttaagagactgagggatccctgagggatccccaaaagcaatgattagaggctgaaaacagaaaaaaaactttggaaacagactggatgttttgtacactcag

SEQ ID NO: 286 - DNA, 323 bp, Artificial
  Synthetic oligonucleotide
gtgagtctgcacttgaatgtcatctctttccagcaataaccatttttcacttccagcctcatgtcaaacagccagtttccatgtggatagtctttgttataaggaatcctaagcaaaagtctgtgaaagctatattcctgattttaaaattcaccacaaacatagtgaatctgcttatttcttatacattcttagaatatatgaaatctaggccatagacttatacaaatgtggacttattattcattgttttccagcataaggcacaagagcatgaggtctgatgttgtagcctgagaatttttgagagatgcctctaataa

SEQ ID NO: 287 - DNA, 123 bp, Artificial
  Synthetic oligonucleotide
ctggtcctgctgatgatgaagcccctgatgctgaaaccactgctgctgcaaccactgcgaccactgctgctcctaccactgcaaccaccgctgcttctaccactgctcgtaaagacattccag

SEQ ID NO: 288 - DNA, 207 bp, Artificial
  Synthetic oligonucleotide
ttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacaaaaaaatggtat

SEQ ID NO: 289 - DNA, 41 bp, Artificial
  Synthetic oligonucleotide
cagcgccttgccttctcttaggctttgaagcatttttgtct

SEQ ID NO: 290 - DNA, 33 bp, Artificial
  Synthetic oligonucleotide
gtgctccctgatcttcaggtcaccaccatgaag

SEQ ID NO: 291 - DNA, 52 bp, Artificial
  Synthetic oligonucleotide
ttcttagcagtcctggtactcttgggagtttccatctttctggtctctgccc

SEQ ID NO: 292 - DNA, 42 bp, Artificial
  Synthetic oligonucleotide
agaatccgacaacagctgctccagctgacacgtatccagcta

SEQ ID NO: 293 - DNA, 29 bp, Artificial
  Synthetic oligonucleotide
ccccttgacaatatttttttctcttgcag

SEQ ID NO: 294 - protein, 90 aa, Homo sapiens
MKFLAVLVLLGVSIFLVSAQNPTTAAPADTYPATGPADDEAPDAETTAAATTATTAAPTTATTAASTTARKDIPVLPKWVGDLPNGRVCP

SEQ ID NO: 295 - protein, 76 aa, Homo sapiens
MKFLAVLVLLGVSIFLVSAQNPTTAAPADTYPATGPADDEAPDAETTAAATTATTAAPTTATTAASTTARKDIPAP

SEQ ID NO: 296 - protein, 105 aa, Homo sapiens
MKFLAVLVLLGVSIFLVSAQNPTTAAPADTYPASESALECHLFPAITIFHFQPHVKQPVSMWIVFVIRNPKQKSVKAIFLILKFTTNIVNLLISYTFLEYMKSRP

SEQ ID NO: 297 - protein, 58 aa, Homo sapiens [sequence omitted]

SEQ ID NO: 298 - DNA, 3615 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttgtaagtatgatgataataaatagccagacaatcatggttgtgaattacagctcttctttcattactctcatgctgtgattccacagtgtgtgggagagaaaataaacacatgtcaatcaaatcagtcaa

SEQ ID NO: 299 - DNA, 2648 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaatgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcata

SEQ ID NO: 300 - DNA, 3475 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaagtctccttttctttctcattattttacaaaaaagtaattaagtttgcttgtgacaaaagatttgtaggaagacatgatgaaaggaaagttgtgaagttgtcattgccattatatctcatatatgaatagcaaatgatgttcttgttaataactcaatgtctggatcaaaacaagaataaatctataattaaacacatgtctttttccctgatctccactgtgagattccttgagtaatattttgtcccctgtagtcatagcacatttctatctggctctttccaacaccttttttctttcattatttttgttgatttctacaaacatattaattaaaaaaaactaatagctttatcgaagtgtaatttaaatactataaatattcccttgttttaagtgtacaagtgaattatttttactaaatttacagatgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcatatgaatgtgtatgtgacctttatgtctgacttctttcattttaggttcatccatgctgtagcatacatatattagtactttgctccttattttgttctcatagtattccattgattgggtataccaggttctgtttacttttacttggcagttgatagaataggtgtagtttatactttttcgctattctccataccggtgctgtagtgaataattgcatacaagtctttgtatagatgtgttttcattctttttggtatatacttagaagcagaattcttgtgttatggtaaacttatattcaatattttgtgaattccactcttttccatatcgattgtaccattttcccttccaagtaaccatgtatgaggatagtcatttctgcacattctcactaatgcttgttattgtctgtcttcttgattacgatcattctcgttggtgtgaaa

SEQ ID NO: 301 - DNA, 1271 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgaggtgaggagcacaagaccagagaaggtcttcgtatttcagtgatatggacatagcagtgcagtttttgaacttatacttatttattccattttaattaagctatgctttgtattttaattgtgttgtaatatttccaggaaaaagtgacttgaatatatttggtacttgttttc

SEQ ID NO: 302 - DNA, 424 bp, Artificial
  Synthetic oligonucleotide
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggag

SEQ ID NO: 303 - DNA, 168 bp, Artificial
  Synthetic oligonucleotide
ctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccag

SEQ ID NO: 304 - DNA, 214 bp, Artificial
  Synthetic oligonucleotide
gtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaa

SEQ ID NO: 305 - DNA, 163 bp, Artificial
  Synthetic oligonucleotide
gtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgag

SEQ ID NO: 306 - DNA, 129 bp, Artificial
  Synthetic oligonucleotide
ggggacattcagcagtttttgatcacaggtgatcccaaggcagcatatgactactgtgagcattatagtccagactgtgactcttcagcacccaaggctgctcaagctcaggaacctcagatagatgag

SEQ ID NO: 307 - DNA, 215 bp, Artificial
  Synthetic oligonucleotide
gtgaggagcacaagaccagagaaggtcttcgtatttcagtgatatggacatagcagtgcagtttttgaacttatacttatttattccattttaattaagctatgctttgtattttaattgtgttgtaatatttccaggaaaaagtgacttgaatatatttggtacttgttttcttgctgtttaagcatttgattacataaatttattagcaataa

SEQ ID NO: 308 - DNA, 214 bp, Artificial
  Synthetic oligonucleotide
ccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttg

SEQ ID NO: 309 - DNA, 430 bp, Artificial
  Synthetic oligonucleotide
gtctccttttctttctcattattttacaaaaaagtaattaagtttgcttgtgacaaaagatttgtaggaagacatgatgaaaggaaagttgtgaagttgtcattgccattatatctcatatatgaatagcaaatgatgttcttgttaataactcaatgtctggatcaaaacaagaataaatctataattaaacacatgtctttttccctgatctccactgtgagattccttgagtaatattttgtcccctgtagtcatagcacatttctatctggctctttccaacaccttttttctttcattatttttgttgatttctacaaacatattaattaaaaaaaactaatagctttatcgaagtgtaatttaaatactataaatattcccttgttttaagtgtacaagtgaattatttttactaaatttacag

SEQ ID NO: 310 - DNA, 639 bp, Artificial
  Synthetic oligonucleotide
atgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcatatgaatgtgtatgtgacctttatgtctgacttctttcattttaggttcatccatgctgtagcatacatatattagtactttgctccttattttgttctcatagtattccattgattgggtataccaggttctgtttacttttacttggcagttgatagaataggtgtagtttatactttttcgctattctccataccggtgctgtagtgaataattgcatacaagtctttgtatagatgtgttttcattctttttggtatatacttagaagcagaattcttgtgttatggtaaacttatattcaatattttgtgaattccactcttttccatatcgattgtaccattttcccttccaagtaaccatgtatgaggatagtcatttctgcacattctcactaatgcttgttattgtctgtcttcttgattacgatcattctcgttggtgtgaaa

SEQ ID NO: 311 - DNA, 129 bp, Artificial
  Synthetic oligonucleotide
gtaagtatgatgataataaatagccagacaatcatggttgtgaattacagctcttctttcattactctcatgctgtgattccacagtgtgtgggagagaaaataaacacatgtcaatcaaatcagtcaa

SEQ ID NO: 312 - DNA, 117 bp, Artificial
  Synthetic oligonucleotide
tatgcaccagaggatataatcgaatatgactatgagtatggggaagcagagtataaagaggctgaaagtgtaacagagggacccactgtaactgaggagacaatagcacagacggag

SEQ ID NO: 313 - DNA, 93 bp, Artificial
  Synthetic oligonucleotide
gcaaacatcgttgatgattttcaagaatacaactatggaacaatggaaagttaccagacagaagctcctaggcatgtttctgggacaaatgag

SEQ ID NO: 314 - DNA, 41 bp, Artificial
  Synthetic oligonucleotide
gtccaggtgtaccagcagaaactgatattacagaaacaagc

SEQ ID NO: 315 - DNA, 63 bp, Artificial
  Synthetic oligonucleotide
ataaatggccatggtgcatatggagagaaaggacagaaaggagaaccagcagtggttgagcct

SEQ ID NO: 316 - DNA, 42 bp, Artificial
  Synthetic oligonucleotide
ggtatgcttgtcgaaggaccaccaggaccagcaggacctgca

SEQ ID NO: 317 - DNA, 63 bp, Artificial
  Synthetic oligonucleotide
ggtattatgggtcctccaggtctacaaggccccactggaccccctggtgaccctggcgatagg

SEQ ID NO: 318 - DNA, 75 bp, Artificial
  Synthetic oligonucleotide
ggccccccaggacgtcctggcttaccaggggctgatggtctacctggtcctcctggtactatgttgatgttaccg

SEQ ID NO: 319 - DNA, 84 bp, Artificial
  Synthetic oligonucleotide
ttccgttatggtggtgatggttccaaaggaccaaccatctctgctcaggaagctcaggctcaagctattcttcagcaggctcgg

SEQ ID NO: 320 - DNA, 57 bp, Artificial
  Synthetic oligonucleotide
attgctctgagaggcccacctggcccaatgggtctaactggaagaccaggtcctgtg

SEQ ID NO: 321 - DNA, 54 bp, Artificial
  Synthetic oligonucleotide
ggggggcctggttcatctggggccaaaggtgagagtggtgatccaggtcctcag

SEQ ID NO: 322 - DNA, 54 bp, Artificial
  Synthetic oligonucleotide
ggccctcgaggcgtccagggtccccctggtccaacgggaaaacctggaaaaagg

SEQ ID NO: 323 - DNA, 54 bp, Artificial
  Synthetic oligonucleotide
ggtcgtccaggtgcagatggaggaagaggaatgccaggagaacctggggcaaag

SEQ ID NO: 324 - DNA, 54 bp, Artificial
  Synthetic oligonucleotide
ggagatcgagggtttgatggacttccgggtctgccaggtgacaaaggtcacagg

SEQ ID NO: 325 - DNA, 54 bp, Artificial
  Synthetic oligonucleotide
ggtgaacgaggtcctcaaggtcctccaggtcctcctggtgatgatggaatgagg

SEQ ID NO: 326 - DNA, 45 bp, Artificial
  Synthetic oligonucleotide
ggagaagatggagaaattggaccaagaggtcttccaggtgaagct

SEQ ID NO: 327 - DNA, 54 bp, Artificial
  Synthetic oligonucleotide
ggcccacgaggtttgctgggtccaaggggaactccaggagctccagggcagcct

SEQ ID NO: 328 - DNA, 45 bp, Artificial
  Synthetic oligonucleotide
ggtatggcaggtgtagatggccccccaggaccaaaagggaacatg

SEQ ID NO: 329 - DNA, 54 bp, Artificial
  Synthetic oligonucleotide
ggtccccaaggggagcctgggcctccaggtcaacaagggaatccaggacctcag

SEQ ID NO: 330 - DNA, 45 bp, Artificial
  Synthetic oligonucleotide
ggtcttcctggtccacaaggtccaattggtcctcctggtgaaaaa

SEQ ID NO: 331 - DNA, 54 bp, Artificial
  Synthetic oligonucleotide
ggaccacaaggaaaaccaggacttgctggacttcctggtgctgatgggcctcct

SEQ ID NO: 332 - DNA, 45 bp, Artificial
  Synthetic oligonucleotide
ggtcatcctgggaaagaaggccagtctggagaaaagggggctctg

SEQ ID NO: 333 - DNA, 54 bp, Artificial
  Synthetic oligonucleotide
ggtccccctggtccacaaggtcctattggatacccgggcccccggggagtaaag

SEQ ID NO: 334 - DNA, 45 bp, Artificial
  Synthetic oligonucleotide
ggagcagatggtgtcagaggtctcaagggatctaaaggtgaaaag

SEQ ID NO: 335 - DNA, 54 bp, Artificial
  Synthetic oligonucleotide
ggtgaagatggttttccaggattcaaaggtgacatgggtctaaaaggtgacaga

SEQ ID NO: 336 - DNA, 108 bp, Artificial
  Synthetic oligonucleotide
ggagaagttggtcaaattggcccaagaggggaagatggccctgaaggacccaaaggtcgagcaggcccaactggagacccaggtccttcaggtcaagcaggagaaaag

SEQ ID NO: 337 - DNA, 54 bp, Artificial
  Synthetic oligonucleotide
ggaaaacttggagttccaggattaccaggatatccaggaagacaaggtccaaag

SEQ ID NO: 338 - DNA, 54 bp, Artificial
  Synthetic oligonucleotide
ggttccactggattccctgggtttccaggtgccaatggagagaaaggtgcacgg

SEQ ID NO: 339 - DNA, 45 bp, Artificial
  Synthetic oligonucleotide
ggagtagctggcaaaccaggccctcggggtcagcgtggtccaacg

SEQ ID NO: 340 - DNA, 54 bp, Artificial
  Synthetic oligonucleotide
ggtcctcgaggttcaagaggtgcaagaggtcccactgggaaacctgggccaaag

SEQ ID NO: 341 - DNA, 45 bp, Artificial
  Synthetic oligonucleotide
ggcacttcaggtggcgatggccctcctggccctccaggtgaaaga

SEQ ID NO: 342 - DNA, 54 bp, Artificial
  Synthetic oligonucleotide
ggtcctcaaggacctcagggtccagttggattccctggaccaaaaggccctcct

SEQ ID NO: 343 - DNA, 54 bp, Artificial
  Synthetic oligonucleotide
ggaccacctgggaaggatgggctgccaggacaccctgggcaacgtggggagact

SEQ ID NO: 344 - DNA, 54 bp, Artificial
  Synthetic oligonucleotide
ggatttcaaggcaagaccggccctcctgggccagggggagtggttggaccacag

SEQ ID NO: 345 - DNA, 108 bp, Artificial
  Synthetic oligonucleotide
ggaccaaccggtgagactggtccaataggggaacgtgggcatcctggccctcctggccctcctggtgagcaaggtcttcctggtgctgcaggaaaagaaggtgcaaag

SEQ ID NO: 346 - DNA, 90 bp, Artificial
  Synthetic oligonucleotide
ggtgatccaggtcctcaaggtatctcagggaaagatggaccagcaggattacgtggtttcccaggggaaagaggtcttcctggagctcag

SEQ ID NO: 347 - DNA, 54 bp, Artificial
  Synthetic oligonucleotide
ggtgcacctggactgaaaggaggggaaggtccccagggcccaccaggtccagtt

SEQ ID NO: 348 - protein, 1806 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGYPGPPGPPGEQGLPGAAGKEGAKGDPGPQGISGKDGPAGLRGFPGERGLPGAQGAPGLKGGEGPQGPPGPVGSPGERGSAGTAGPIGLRGRPGPQGPPGPAGEKGAPGEKGPQGPAGRDGVQGPVGLPGPAGPAGSPGEDGDKGEIGEPGQKGSKGGKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGELGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGPPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCTSRKGYEKTVIEINTPKIDQVPIVDVMISDFGDQNQKFGFEVGPVCFLG

SEQ ID NO: 349 - protein, 1806 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLRGRPGPQGPPGPAGEKGAPGEKGPQGPAGRDGVQGPVGLPGPAGPAGSPGEDGDKGEIGEPGQKGSKGGKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGELGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGPPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCTSRKGYEKTVIEINTPKIDQVPIVDVMISDFGDQNQKFGFEVGPVCFLG

SEQ ID NO: 350 - protein, 1081 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVVSMMIINSQTIMVVNYSSSFITLML

SEQ ID NO: 351 - protein, 729 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKMCCNLSFGILIPLQK

SEQ ID NO: 352 - protein, 738 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGMAGVDGPPGPKGNMGPQGEPGPPGQQGNPGPQGLPGPQGPIGPPGEKVSFSFSLFYKKVIKFACDKRFVGRHDERKVVKLSLPLYLIYE

SEQ ID NO: 353 - protein, 273 aa, Homo sapiens [sequence omitted]

SEQ ID NO: 354 - DNA, 5503 bp, Homo sapiens
ctgtccccggccccggcgcgggggagacgtgagcgtgcacacgtacacacacagcaggggaagaggcgctccaagcggcgcccaactttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaatgctacaagatagaaattactatgcccaagaggaggaaagtgaagctaagagattagagaactcggactgagaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggtcaaaaagcatatgcatccttatccgtcaactcatcagctcttcctcaaggcaacctgaggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggct

SEQ ID NO: 355 - DNA, 1298 bp, Artificial
  Synthetic oligonucleotide
ctgtccccggccccggcgcgggggagacgtgagcgtgcacacgtacacacacagcaggggaagaggcgctccaagcggcgcccaactttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtg

SEQ ID NO: 356 - DNA, 170 bp, Artificial
  Synthetic oligonucleotide
ggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacag

SEQ ID NO: 357 - DNA, 143 bp, Artificial
  Synthetic oligonucleotide
cggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccag

SEQ ID NO: 358 - DNA, 148 bp, Artificial
  Synthetic oligonucleotide
ggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcgg

SEQ ID NO: 359 - DNA, 168 bp, Artificial
  Synthetic oligonucleotide
ctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccag

SEQ ID NO: 360 - DNA, 578 bp, Artificial
  Synthetic oligonucleotide
cagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtc

SEQ ID NO: 361 - DNA, 691 bp, Artificial
  Synthetic oligonucleotide
ggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagaga

SEQ ID NO: 362 - DNA, 131 bp, Artificial
  Synthetic oligonucleotide
ctaaaaatacgaggaaaggagagtgaggattttcattaaaagtctcagcagtgggtttcttgggttatttaaaacatcacctaaataggccttttcttcctaattggccatcaaattaaagcctatccttt

SEQ ID NO: 363 - DNA, 247 bp, Artificial
  Synthetic oligonucleotide
ctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccag

SEQ ID NO: 364 - DNA, 126 bp, Artificial
  Synthetic oligonucleotide
gacacagtttactgatctctgttctagtgagtgggtcaaaaagcatatgcatccttatccgtcaactcatcagctcttcctcaaggcaacctgaggccagacaccaagaaaccaagcgtatctgct

SEQ ID NO: 365 - DNA, 231 bp, Artificial
  Synthetic oligonucleotide
ctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccag

SEQ ID NO: 366 - DNA, 1079 bp, Artificial
  Synthetic oligonucleotide
ctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggct

SEQ ID NO: 367 - DNA, 38 bp, Artificial
  Synthetic oligonucleotide
ggaggaggaggggaagcggcgaaggaggaagaggagga

SEQ ID NO: 368 - DNA, 41 bp, Artificial
  Synthetic oligonucleotide
gagctcccagcagaaaggccgcctgtccctgcagaatacag

SEQ ID NO: 369 - DNA, 11 bp, Artificial
  Synthetic oligonucleotide
ctgcccaggag

SEQ ID NO: 370 - DNA, 53 bp, Artificial
  Synthetic oligonucleotide
aacacccgggtgatagtggagatgatccatttcaaggacttgctgctgcacga

SEQ ID NO: 371 - DNA, 73 bp, Artificial
  Synthetic oligonucleotide
atgctacaagatagaaattactatgcccaagaggaggaaagtgaagctaagagattagagaactcggactgag

SEQ ID NO: 372 - DNA, 33 bp, Artificial
  Synthetic oligonucleotide
accctacgtggacctcgtgaacttgctgctgac

SEQ ID NO: 373 - DNA, 12 bp, Artificial
  Synthetic oligonucleotide
ggcccaccacgg

SEQ ID NO: 374 - DNA, 30 bp, Artificial
  Synthetic oligonucleotide
ggaagcaggacatcacctcccagagcccag

SEQ ID NO: 375 - DNA, 103 bp, Artificial
  Synthetic oligonucleotide
tccgcggaagtcagggcggctggattccaggacaggagtgaatgtaaaaataaatatcgcttagaatgcaggagaagggtggagaggaggcaggggccgaggg

SEQ ID NO: 376 - DNA, 77 bp, Artificial
  Synthetic oligonucleotide
ggtgcttggtgccaaactgaaattcagtttcttgtgtggggccttgcggttcagagctcttggcgagggtggaggga

SEQ ID NO: 377 - DNA, 5 bp, Artificial
  Synthetic oligonucleotide
cagaa

SEQ ID NO: 378 - DNA, 17 bp, Artificial
  Synthetic oligonucleotide
ctgaatttcactcacag

SEQ ID NO: 379 - protein, 302 aa, Homo sapiens
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGEAGHHLPEPSSRETGRGAKGERGSKSHPNAHARGRVGGLGAQGPSGSSEWEDEQSEYSDIRR

SEQ ID NO: 380 - protein, 187 aa, Homo sapiens
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHECYKIEITMPKRRKVKLRD

SEQ ID NO: 381 - DNA, 2201 bp, Homo sapiens
tgagacaagatgtcactctgtcacccaggctggagtgcagtggcaggatcacggctcactgcagcctcgacctccctgggctcaggtgatcctcccacctcagcctaccgagtagctgggactacaggtgcatgtcaccatacccggttaatttttgtattttttttagagacaaggtctcaccatgttgcccaggctggtctcaaactcctgtgctcaggcaatgcgtcagcctcgacatctcaaagtgctgtgattacaggcgtgagccccgacacctggcctagttctattttctaaatgtgaattctgtaaagatatcttttaaaaataaagttctgtttttggtagaaaatgtaaaaatagataaatatggagggaagaaatcccccctggaatacagacgcttcctctcccttccagccttttccccatatgaacattgctgtgagtgagacttacatgcaatgtaatttctttttgagcttaacattacaacataaattctcaaactctgatgttcattaaacaccccagccccatcctgggaacttgggcttggggctcggggtgttctgataatgatcaaagtatgagaattgaacccatgaggactttgatccaagatactggggtgtggggaggggcaggcacaggtgtcctgggaacacactttgagaagcaatggcaaagctgggggtccagctaatgtgttacattagaatcacctcggggaggccctgggtgcccttctcagccctccctccggaggctgctgaagcccagcaaagccggagtcagagaacaatgtccgcctgagggcagggctgggctgggctggccttctggccctatctgctccgtgcccaacccagcgccccgcacagtcggagctttgtaaatacgaggtgactgtctgcctacaaactttgtaaacatcacttgaaatggccgcagggcattgcgacatggccataccactatttgtttgctattgaatttgtacttccctgccttacttttgctattgcaaaccatgctgtcactaaggtcttcatgcacacagttgtgtcttggtcagatgatatgtttctaccaattttaattgtgtttctttccacctggacacacagctctctggcccagggctgggtcatcagcacaccctgctgctgctgttcagatctgcatcctggtcccgcttggtcccacagtgagaacgctttgctatcacatgggcaggctctgagagccctgccggcctggccttctcaaagaagacctgagagcttgggacccaagcagagaggaagaacagggctcagggtgcttgctccatgctcgctccacacctggggctcaaccctggctttccccggctccctgtgtgacttcagggcaggtcccttgggccctctgggccttatcatcttcatctgtaacagggcgatgcctctgccgtgtctggtggtgttgaggagttcctgtttgtgtaagcagctagttcagtgccagcacgagatgggaggcccatgaagttagcagtgcacaaaaaatagagcaaagactggatgcatttcctgagaacaaccatcactgtaaagcactttacaaatccaaagacaacccccggcaaaaactcaaaatgaaactccctctcgcagagcacaattccaattcgctctaaaaacattacaagttagttcatgtcatgccagatagctgaaggcagctcacaagttcttaaggccaggaatgccatgtgtctgctatgcacagctggccctggccctgagcctgaatgacagcacaaaggtgacgcagatgtgggtgccctgctcctgcccagcagcagtgcttggtggaggctgaggccctgcacaggcaccctcactgctgaccttgagcctctctctcctctagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatga

SEQ ID NO: 382 - DNA, 1133 bp, Artificial
  Synthetic oligonucleotide
tgagacaagatgtcactctgtcacccaggctggagtgcagtggcaggatcacggctcactgcagcctcgacctccctgggctcaggtgatcctcccacctcagcctaccgagtagctgggactacaggtgcatgtcaccatacccggttaatttttgtattttttttagagacaaggtctcaccatgttgcccaggctggtctcaaactcctgtgctcaggcaatgcgtcagcctcgacatctcaaagtgctgtgattacaggcgtgagccccgacacctggcctagttctattttctaaatgtgaattctgtaaagatatcttttaaaaataaagttctgtttttggtagaaaatgtaaaaatagataaatatggagggaagaaatcccccctggaatacagacgcttcctctcccttccagccttttccccatatgaacattgctgtgagtgagacttacatgcaatgtaatttctttttgagcttaacattacaacataaattctcaaactctgatgttcattaaacaccccagccccatcctgggaacttgggcttggggctcggggtgttctgataatgatcaaagtatgagaattgaacccatgaggactttgatccaagatactggggtgtggggaggggcaggcacaggtgtcctgggaacacactttgagaagcaatggcaaagctgggggtccagctaatgtgttacattagaatcacctcggggaggccctgggtgcccttctcagccctccctccggaggctgctgaagcccagcaaagccggagtcagagaacaatgtccgcctgagggcagggctgggctgggctggccttctggccctatctgctccgtgcccaacccagcgccccgcacagtcggagctttgtaaatacgaggtgactgtctgcctacaaactttgtaaacatcacttgaaatggccgcagggcattgcgacatggccataccactatttgtttgctattgaatttgtacttccctgccttacttttgctattgcaaaccatgctgtcactaaggtcttcatgcacacagttgtgtcttggtcagatgatatgtttctaccaattttaattgtgtttctttccacctggacacacag

SEQ ID NO: 383 - DNA, 790 bp, Artificial
  Synthetic oligonucleotide
ctctctggcccagggctgggtcatcagcacaccctgctgctgctgttcagatctgcatcctggtcccgcttggtcccacagtgagaacgctttgctatcacatgggcaggctctgagagccctgccggcctggccttctcaaagaagacctgagagcttgggacccaagcagagaggaagaacagggctcagggtgcttgctccatgctcgctccacacctggggctcaaccctggctttccccggctccctgtgtgacttcagggcaggtcccttgggccctctgggccttatcatcttcatctgtaacagggcgatgcctctgccgtgtctggtggtgttgaggagttcctgtttgtgtaagcagctagttcagtgccagcacgagatgggaggcccatgaagttagcagtgcacaaaaaatagagcaaagactggatgcatttcctgagaacaaccatcactgtaaagcactttacaaatccaaagacaacccccggcaaaaactcaaaatgaaactccctctcgcagagcacaattccaattcgctctaaaaacattacaagttagttcatgtcatgccagatagctgaaggcagctcacaagttcttaaggccaggaatgccatgtgtctgctatgcacagctggccctggccctgagcctgaatgacagcacaaaggtgacgcagatgtgggtgccctgctcctgcccagcagcagtgcttggtggaggctgaggccctgcacaggcaccctcactgctgaccttgagcctctctctcctctag

SEQ ID NO: 384 - DNA, 643 bp, Artificial
  Synthetic oligonucleotide
agtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgatcctggtctcagagaaactggttatttccttaaaacctcagtgtcctctccccacaaaacagaattcactaattaaacttgtcatttcattactcattgcctgcctgcagtggtgagacagatgaagaagacaaggcagtcgataaaaatccatttgttggccatcttctgagtgcccactgagacacagtcccacctttggccgtgtgaatgccaccatgtcctggacccaagggaggctcgggtacacacatccatgtatttattcatctacttcgtaattcatttagtcggtcacgtagccactcattgaacctgggcccctccatctctccaaacagcatgttttcttcaagtaacatact

SEQ ID NO: 385 - protein, 95 aa, Homo sapiens
MTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 386 - protein, 159 aa, Homo sapiens
MHTVVSWSDDMFLPILIVFLSTWTHSSLAQGWVISTPCCCCSDLHPGPAWSHSENALLSHGQALRALPAWPSQRRPESLGPKQRGRTGLRVLAPCSLHTWGSTLAFPGSLCDFRAGPLGPLGLIIFICNRAMPLPCLVVLRSSCLCKQLVQCQHEMGGP

SEQ ID NO: 387 - DNA, 5989 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgaggccccataggagcctgagcatacaggagttgggggagccagggcccagtgaggggtggggaggctaaccgggccaggactctggccatcctcgttttcctgccctcaggtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 388 - DNA, 6134 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggtgatgtcaccctgtctgggcctcaggtgaccctgcttccatttccctgtaccccagctccctgttccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctgatctctgcccctgtgcccacgcttcctttccctcaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 389 - DNA, 6247 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggtgatgtcaccctgtctgggcctcaggtgaccctgcttccatttccctgtaccccagctccctgttccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctgatctctgcccctgtgcccacgcttcctttccctcaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgaggccccataggagcctgagcatacaggagttgggggagccagggcccagtgaggggtggggaggctaaccgggccaggactctggccatcctcgttttcctgccctcaggtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 390 - DNA, 6055 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggttctgggtgcaagggcaagcaggaggggggccaggaaaggacagttactggaagatggacagcccaggaggctacagagggaaagaaagggggcccctgatgaggatggggagcatggccttgggctcaaacagcagaagggtgagtgtcacctgagcggccacctctcctctccaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 391 - DNA, 5975 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggtttcttccagaggggaaggatgagtagggaggatgtggtagttaggagggctcagggtctgaccactctcttttgcctgccctcctttacctgcctaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 392 - DNA, 5673 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 393 - DNA, 7367 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 394 - DNA, 6925 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgctggtggctccgaatcccactcctcagcccaggcctcttccctgaaccatgggccccactcgtcccactcccacagcacctcagacgaggcatgtcccaaagcccttcttcattctgtgtctcttgtctggctggtgggagcccctcccagccaggagcccagccactactctagaggccgtgttagtggcccctctcccaagcctgtccttatgtccctagtgactcctcctctgctcccctgctgcctgtggcccttggtgctgcatcctagattctgtgctgagacggccttctccctacctggaacttctctctacctcctgtctcccctgtctgatccactgtccacacggcagtgacactgaccttccaaaagccccagccagatcagccttggggaaaagtcactccccgctgcccacggctcagatggctgggcctctgcccacccctccggccagacagctctccttgtctacacagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtatgcgccgccgcctgtggcgaatgtggtgccactcgtgtgtgtggactgtgcagtgacggggaggaaaaggggctgaaggcctcaaatcccgtagcccagggagatgcccttaggtatggcaccagagaggtctgtggcctcacatgtcccacgtcctctccctgccccttgctgagccaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 395 - DNA, 7571 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggtgggcgccgggagctgccctgggccaggggagggagggcaggacccaggctggggctgggcttctggagcccgcgcaggcagaacctggacgacagctcacacgtctccacaggcggaacggcaaggtggggctgtctggcatggccatcgcggacgtcaccctcctgagtggattccacgccctgcgtgctgacctggagaaggtgtggtcagccacccagggcaaccccctctgtcccaggtactgagccctgtcatgtgcagggcctgtgaccaactccccttttccacagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 396 - DNA, 6269 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccaacctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtgctggtataaactttgtggaaatgtgaggtggggagaggaggtggggctgttttgaggaaggagataagttactggagccgcaaaaacaggtttgcttgtgcccttctaacatcgccttcccttttctgttgctgaagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 397 - DNA, 5829 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 398 - DNA, 6351 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagtaggggccgtccccgggctctggcgggggtgggtagtcctcagaccaagggcttgcttgagtcctggctcaacctccctaggacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccaacctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtgctggtataaactttgtggaaatgtgaggtggggagaggaggtggggctgttttgaggaaggagataagttactggagccgcaaaaacaggtttgcttgtgcccttctaacatcgccttcccttttctgttgctgaagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 399 - DNA, 7532 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccggtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccagagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 400 - DNA, 7765 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggcagcgaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgcctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatctttctcccagtagctgctcagcatggtggtggcataagcccattttccggagccagggattcagttgcagcaagacatggcccggtctgggaggtcaaccatgaagaaggcagtagctgtcattgcccaaccccagaaatcccaatcctgttttctc

SEQ ID NO: 401 - DNA, 7947 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggctgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggcagcgaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgcctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatctttctcccagtagctgctcagcatggtggtggcataagcccattttccggagccagggattcagttgcagcaagacatggcccggtctgggaggtcaaccatgaagaaggcagtagctgtcattgcccaaccccagaaatcccaatcctgttttctc

SEQ ID NO: 402 - DNA, 5773 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 403 - DNA, 5961 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 404 - DNA, 7889 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggctgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggcagcgaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgcctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatctttctcccagtagctgctcagcatggtggtggcataagcccattttccggagccagggattcagttgcagcaagacatggcccggtctgggaggtcaaccatgaagaaggcagtagctgtcattgcccaaccccagaaatcccaatcctgttttctc

SEQ ID NO: 405 - DNA, 4914 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcacgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 406 - DNA, 535 bp, Artificial
  Synthetic oligonucleotide
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccag

SEQ ID NO: 407 - DNA, 199 bp, Artificial
  Synthetic oligonucleotide
gttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccag

SEQ ID NO: 408 - DNA, 121 bp, Artificial
  Synthetic oligonucleotide
gtgcccttgaaagatgcgaagagctgtggcctccatcaactcctcagaggccctgaggtccagctggtggcccattcgccatggctaaaggactctctgtccagaacgacaaacatccagg

SEQ ID NO: 409 - DNA, 180 bp, Artificial
  Synthetic oligonucleotide
gccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctca

SEQ ID NO: 410 - DNA, 183 bp, Artificial
  Synthetic oligonucleotide
gtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatg

SEQ ID NO: 411 - DNA, 186 bp, Artificial
  Synthetic oligonucleotide
atcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaag

SEQ ID NO: 412 - DNA, 159 bp, Artificial
  Synthetic oligonucleotide
ctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaag

SEQ ID NO: 413 - DNA, 127 bp, Artificial
  Synthetic oligonucleotide
gtctttgaagctatgaacagctatgacctcggctgtggtcctgggggtggggacagtgcccttcaggtgttccaggcagcgggcctggccttttctgatggagaccagtggaccttatccagaaaga

SEQ ID NO: 414 - DNA, 198 bp, Artificial
  Synthetic oligonucleotide
tgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgag

SEQ ID NO: 415 - DNA, 258 bp, Artificial
  Synthetic oligonucleotide
gtgatgtcaccctgtctgggcctcaggtgaccctgcttccatttccctgtaccccagctccctgttccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctgatctctgcccctgtgcccacgcttcctttccctcag

SEQ ID NO: 416 - DNA, 140 bp, Artificial
  Synthetic oligonucleotide
gcctatgtgtggccaccccagtccagctccgggtgttccgcgagttccacctgcacctccgcctgcccatgtctgtccgccgctttgagcagctggagctgcggcctgtcctctataactacctggataaaaacctgact

SEQ ID NO: 417 - DNA, 210 bp, Artificial
  Synthetic oligonucleotide
gtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgag

SEQ ID NO: 418 - DNA, 163 bp, Artificial
  Synthetic oligonucleotide
ggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaag

SEQ ID NO: 419 - DNA, 179 bp, Artificial
  Synthetic oligonucleotide
gttctgggtgcaagggcaagcaggaggggggccaggaaaggacagttactggaagatggacagcccaggaggctacagagggaaagaaagggggcccctgatgaggatggggagcatggccttgggctcaaacagcagaagggtgagtgtcacctgagcggccacctctcctctccaag

SEQ ID NO: 420 - DNA, 157 bp, Artificial
  Synthetic oligonucleotide
gctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcag

SEQ ID NO: 421 - DNA, 172 bp, Artificial
  Synthetic oligonucleotide
gaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggag

SEQ ID NO: 422 - DNA, 131 bp, Artificial
  Synthetic oligonucleotide
tgtggattgaaaccacagcctacgccctgctgcacctcctgcttcacgagggcaaagcagagatggcagaccaggctgcggcctggctcacccgtcagggcagcttccaagggggattccgcagtacccaa

SEQ ID NO: 423 - DNA, 393 bp, Artificial
  Synthetic oligonucleotide
gtgaaccactccctggtgaaccactccctcgcctgggtagccaggacacctgggcctcgtggccaggccagaagccgtccccaacctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtgctggtataaactttgtggaaatgtgaggtggggagaggaggtggggctgttttgaggaaggagataagttactggagccgcaaaaacaggtttgcttgtgcccttctaacatcgccttcccttttctgttgctgaag

SEQ ID NO: 424 - DNA, 1049 bp, Artificial
  Synthetic oligonucleotide
gtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgctggtggctccgaatcccactcctcagcccaggcctcttccctgaaccatgggccccactcgtcccactcccacagcacctcagacgaggcatgtcccaaagcccttcttcattctgtgtctcttgtctggctggtgggagcccctcccagccaggagcccagccactactctagaggccgtgttagtggcccctctcccaagcctgtccttatgtccctagtgactcctcctctgctcccctgctgcctgtggcccttggtgctgcatcctagattctgtgctgagacggccttctccctacctggaacttctctctacctcctgtctcccctgtctgatccactgtccacacggcagtgacactgaccttccaaaagccccagccagatcagccttggggaaaagtcactccccgctgcccacggctcagatggctgggcctctgcccacccctccggccagacagctctccttgtctacacagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtatgcgccgccgcctgtggcgaatgtggtgccactcgtgtgtgtggactgtgcagtgacggggaggaaaaggggctgaaggcctcaaatcccgtagcccagggagatgcccttaggtatggcaccagagaggtctgtggcctcacatgtcccacgtcctctccctgccccttgctgagccag

SEQ ID NO: 425 - DNA, 1482 bp, Artificial
  Synthetic oligonucleotide
gtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacg

SEQ ID NO: 426 - DNA, 165 bp, Artificial
  Synthetic oligonucleotide
gtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccag

SEQ ID NO: 427 - DNA, 182 bp, Artificial
  Synthetic oligonucleotide
gtcagtcttcccaccgaggccctggcctgaccctccctcggggaccggctgttttggtctctctgggtgtagcctgctcctcttacaggtcatgcacgcagcctgtttgctctgacaccaacttcctaccctctcagcctcaaagtaactcacctttcccccttctcctcaccccctcttag

SEQ ID NO: 428 - DNA, 262 bp, Artificial
  Synthetic oligonucleotide
gtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcag

SEQ ID NO: 429 - DNA, 133 bp, Artificial
  Synthetic oligonucleotide
ccaaggatgtcaaggccgctgctaatcagatgcgcaacttcctggttcgagcctcctgccgccttcgcttggaacctgggaaagaatatttgatcatgggtctggatggggccacctatgacctcgagggaca

SEQ ID NO: 430 - DNA, 143 bp, Artificial
  Synthetic oligonucleotide
gtgagtcatctggtcccctcagtctcttgtcctccccatgcctcgccacctaggccttgcccctcagaagccagatgcctgtgctctccgtttccacctgccatcctcccgagccctgctgactgcccctttgccccctgcag

SEQ ID NO: 431 - DNA, 150 bp, Artificial
  Synthetic oligonucleotide
cccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgcc

SEQ ID NO: 432 - DNA, 380 bp, Artificial
  Synthetic oligonucleotide
ggcatattaaaggcttttggcagcaaagtgtcagtgttggcagcgaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgc

SEQ ID NO: 433 - DNA, 1146 bp, Artificial
  Synthetic oligonucleotide
ctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatctttctcccagtagctgctcagcatggtggtggcataagcccattttccggagccagggattcagttgcagcaagacatggcccggtctgggaggtcaaccatgaagaaggcagtagctgtcattgcccaaccccagaaatcccaatcctgttttctc

SEQ ID NO: 434 - DNA, 30 bp, Artificial
  Synthetic oligonucleotide
cttcttcaccttatctctgcagaagcccag

SEQ ID NO: 435 - DNA, 81 bp, Artificial
  Synthetic oligonucleotide
gtatcaacctgctcttctcctctcgccgggggcacctctttttgcagacggaccagcccatttacaaccctggccagcggg

SEQ ID NO: 436 - DNA, 71 bp, Artificial
  Synthetic oligonucleotide
ttcggtaccgggtctttgctctggatcagaagatgcgcccgagcactgacaccatcacagtcatggtggag

SEQ ID NO: 437 - DNA, 89 bp, Artificial
  Synthetic oligonucleotide
aactctcacggcctccgcgtgcggaagaaggaggtgtacatgccctcgtccatcttccaggatgactttgtgatcccagacatctcaga

SEQ ID NO: 438 - DNA, 83 bp, Artificial
  Synthetic oligonucleotide
gccagggacctggaagatctcagcccgattctcagatggcctggaatccaacagcagcacccagtttgaggtgaagaaatatg

SEQ ID NO: 439 - DNA, 97 bp, Artificial
  Synthetic oligonucleotide
tccttcccaactttgaggtgaagatcacccctggaaagccctacatcctgacggtgccaggccatcttgatgaaatgcagttagacatccaggccag

SEQ ID NO: 440 - DNA, 106 bp, Artificial
  Synthetic oligonucleotide
gtacatctatgggaagccagtgcagggggtggcatatgtgcgctttgggctcctagatgaggatggtaagaagactttctttcgggggctggagagtcagaccaag

SEQ ID NO: 441 - DNA, 27 bp, Artificial
  Synthetic oligonucleotide
ctggtgaatggacagagccacatttcc

SEQ ID NO: 442 - DNA, 106 bp, Artificial
  Synthetic oligonucleotide
ctctcaaaggcagagttccaggacgccctggagaagctgaatatgggcattactgacctccaggggctgcgcctctacgttgctgcagccatcattgagtctccag

SEQ ID NO: 443 - DNA, 116 bp, Artificial
  Synthetic oligonucleotide
gtggggagatggaggaggcagagctcacatcctggtattttgtgtcatctcccttctccttggatcttagcaagaccaagcgacaccttgtgcctggggcccccttcctgctgcag

SEQ ID NO: 444 - DNA, 99 bp, Artificial
  Synthetic oligonucleotide
gtttcttccagaggggaaggatgagtagggaggatgtggtagttaggagggctcagggtctgaccactctcttttgcctgccctcctttacctgcctag

SEQ ID NO: 445 - DNA, 75 bp, Artificial
  Synthetic oligonucleotide
gactaagctgtcccaaggagaagacaacccggaaaaagagaaacgtgaacttccaaaaggcgattaatgagaaat

SEQ ID NO: 446 - DNA, 112 bp, Artificial
  Synthetic oligonucleotide
ccctggagatcctgcaggaggaggacctgattgatgaggatgacattcccgtgcgcagcttcttcccagagaactggctctggagagtggaaacagtggaccgctttcaaat

SEQ ID NO: 447 - DNA, 71 bp, Artificial
  Synthetic oligonucleotide
attgacactgtggctccccgactctctgaccacgtgggagatccatggcctgagcctgtccaaaaccaaag

SEQ ID NO: 448 - DNA, 113 bp, Artificial
  Synthetic oligonucleotide
gtgaggccccataggagcctgagcatacaggagttgggggagccagggcccagtgaggggtggggaggctaaccgggccaggactctggccatcctcgttttcctgccctcag

SEQ ID NO: 449 - DNA, 52 bp, Artificial
  Synthetic oligonucleotide
aaggaaggggccatccatagagaggagctggtctatgaactcaaccccttgg

SEQ ID NO: 450 - DNA, 90 bp, Artificial
  Synthetic oligonucleotide
accaccgaggccggaccttggaaatacctggcaactctgatcccaatatgatccctgatggggactttaacagctacgtcagggttacag

SEQ ID NO: 451 - DNA, 47 bp, Artificial
  Synthetic oligonucleotide
cctcagatccattggacactttaggctctgagggggccttgtcacca

SEQ ID NO: 452 - DNA, 76 bp, Artificial
  Synthetic oligonucleotide
gctacatgcggatccagcagtttcggaaggcggatggttcctatgcggcttggttgtcacgggacagcagcacctg

SEQ ID NO: 453 - DNA, 117 bp, Artificial
  Synthetic oligonucleotide
gggggtttggtgggcaatgatgagactgtggcactcacagcctttgtgaccatcgcccttcatcatgggctggccgtcttccaggatgagggtgcagagccattgaagcagagagtg

SEQ ID NO: 454 - DNA, 20 bp, Artificial
  Synthetic oligonucleotide
ataacctgtactggggctca

SEQ ID NO: 455 - DNA, 40 bp, Artificial
  Synthetic oligonucleotide
gtcactggttctcagagcaatgccgtgtcgcccaccccgg

SEQ ID NO: 456 - DNA, 42 bp, Artificial
  Synthetic oligonucleotide
ctcctcgcaacccatccgaccccatgccccaggccccagccc

SEQ ID NO: 457 - DNA, 82 bp, Artificial
  Synthetic oligonucleotide
gtaggggccgtccccgggctctggcgggggtgggtagtcctcagaccaagggcttgcttgagtcctggctcaacctccctag

SEQ ID NO: 458 - DNA, 24 bp, Artificial
  Synthetic oligonucleotide
gacacggtgattgccctggatgcc

SEQ ID NO: 459 - DNA, 80 bp, Artificial
  Synthetic oligonucleotide
ctgtctgcctactggattgcctcccacaccactgaggagaggggtctcaatgtgactctcagctccacaggccggaatgg

SEQ ID NO: 460 - DNA, 64 bp, Artificial
  Synthetic oligonucleotide
gttcaagtcccacgcgctgcagctgaacaaccgccagattcgcggcctggaggaggagctgcag

SEQ ID NO: 461 - DNA, 60 bp, Artificial
  Synthetic oligonucleotide
ttttccttgggcagcaagatcaatgtgaaggtgggaggaaacagcaaaggaaccctgaag

SEQ ID NO: 462 - DNA, 94 bp, Artificial
  Synthetic oligonucleotide
gtccttcgtacctacaatgtcctggacatgaagaacacgacctgccaggacctacagatagaagtgacagtcaaaggccacgtcgagtacacga

SEQ ID NO: 463 - DNA, 11 bp, Artificial
  Synthetic oligonucleotide
tggaagcaaac

SEQ ID NO: 464 - DNA, 116 bp, Artificial
  Synthetic oligonucleotide
gaggactatgaggactatgagtacgatgagcttccagccaaggatgacccagatgcccctctgcagcccgtgacacccctgcagctgtttgagggtcggaggaaccgccgcaggag

SEQ ID NO: 465 - DNA, 13 bp, Artificial
  Synthetic oligonucleotide
ggaggcgcccaag

SEQ ID NO: 466 - DNA, 47 bp, Artificial
  Synthetic oligonucleotide
gtggtggaggagcaggagtccagggtgcactacaccgtgtgcatctg

SEQ ID NO: 467 - DNA, 114 bp, Artificial
  Synthetic oligonucleotide
gtgggcgccgggagctgccctgggccaggggagggagggcaggacccaggctggggctgggcttctggagcccgcgcaggcagaacctggacgacagctcacacgtctccacag

SEQ ID NO: 468 - DNA, 91 bp, Artificial
  Synthetic oligonucleotide
gcggaacggcaaggtggggctgtctggcatggccatcgcggacgtcaccctcctgagtggattccacgccctgcgtgctgacctggagaag

SEQ ID NO: 469 - DNA, 90 bp, Artificial
  Synthetic oligonucleotide
gtgtggtcagccacccagggcaaccccctctgtcccaggtactgagccctgtcatgtgcagggcctgtgaccaactccccttttccacag

SEQ ID NO: 470 - DNA, 9 bp, Artificial
  Synthetic oligonucleotide
ctgacctcc

SEQ ID NO: 471 - DNA, 11 bp, Artificial
  Synthetic oligonucleotide
ctctctgaccg

SEQ ID NO: 472 - DNA, 37 bp, Artificial
  Synthetic oligonucleotide
ttacgtgagtcactttgagaccgaggggccccacgtc

SEQ ID NO: 473 - DNA, 18 bp, Artificial
  Synthetic oligonucleotide
ctgctgtattttgactcg

SEQ ID NO: 474 - DNA, 9 bp, Artificial
  Synthetic oligonucleotide
cttggccag

SEQ ID NO: 475 - DNA, 8 bp, Artificial
  Synthetic oligonucleotide
gtccccac

SEQ ID NO: 476 - DNA, 17 bp, Artificial
  Synthetic oligonucleotide
ctcccgggagtgcgtgg

SEQ ID NO: 477 - DNA, 49 bp, Artificial
  Synthetic oligonucleotide
gctttgaggctgtgcaggaagtgccggtggggctggtgcagccggccag

SEQ ID NO: 478 - DNA, 29 bp, Artificial
  Synthetic oligonucleotide
cgcaaccctgtacgactactacaaccccg

SEQ ID NO: 479 - DNA, 90 bp, Artificial
  Synthetic oligonucleotide
agcgcagatgttctgtgttttacggggcaccaagtaagagcagactcttggccaccttgtgttctgctgaagtctgccagtgtgctgagg

SEQ ID NO: 480 - DNA, 85 bp, Artificial
  Synthetic oligonucleotide
gtgagactgagggcctggggcggggcagtggaggcgggatggccggggccccccccacactgtctgatgggttccccaacttcag

SEQ ID NO: 481 - DNA, 73 bp, Artificial
  Synthetic oligonucleotide
ggaagtgccctcgccagcgtcgcgccctggagcggggtctgcaggacgaggatggctacaggatgaagtttgc

SEQ ID NO: 482 - DNA, 26 bp, Artificial
  Synthetic oligonucleotide
ctgctactacccccgtgtggagtacg

SEQ ID NO: 483 - DNA, 84 bp, Artificial
  Synthetic oligonucleotide
gcttccaggttaaggttctccgagaagacagcagagctgctttccgcctctttgagaccaagatcacccaagtcctgcacttca

SEQ ID NO: 484 - DNA, 91 bp, Artificial
  Synthetic oligonucleotide
ctcccacctccgctgggaggaacctgaacctgggaaccatgaagctggaagcactgctgtgtccgctttcatgaacacagcctgggaccag

SEQ ID NO: 485 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALSLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 486 - protein, 1744 aa, Homo sapiens [sequence omitted]

SEQ ID NO: 487 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 488 - protein, 887 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVRPHRSLSIQELGEPGPSEGWGG

SEQ ID NO: 489 - protein, 843 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGDVTLSGPQVTLLPFPCTPAPCSLCS

SEQ ID NO: 490 - protein, 1084 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGSGCKGKQEGGQERTVTGRWTAQEATEGKKGGP

SEQ ID NO: 491 - protein, 1397 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVRAREGVGPGTGGGEGVE

SEQ ID NO: 492 - protein, 1415 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQVNHSLVNHSLAWVARTPGPRGQARSRPQPPTRGIPAALLPGVFGGRLTSWLRDLEL

SEQ ID NO: 493 - protein, 1483 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKAERQGGAVWHGHRGRHPPEWIPRPAC

SEQ ID NO: 494 - protein, 1349 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQVGAVPGLWRGWVVLRPRACLSPGSTSLGHGDCPGCPVCLLDCLPHH

SEQ ID NO: 495 - protein, 1533 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVSGER

SEQ ID NO: 496 - protein, 1670 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFSMKQTGEAGRAGGRQGG

SEQ ID NO: 497 - protein, 1685 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGQSSHRGPGLTLPRGPAVLVSLGVACSSYRSCTQPVCSDTNFLPSQPQSNSPFPLLLTPS

SEQ ID NO: 498 - protein, 1579 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSSADVLCFTGHQVRADSWPPCVLLKSASVLRGSALASVAPWSGVCRTRMATG

SEQ ID NO: 499 - protein, 1657 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGETEGLGRGSGGGMAGAPPTLSDGFPNFREVPSPASRPGAGSAGRGWLQDEVCLLLPPCGVRLPG

SEQ ID NO: 500 - protein, 1691 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGETEGLGRGSGGGMAGAPPTLSDGFPNFREVPSPASRPGAGSAGRGWLQDEVCLLLPPCGVRSVFPPRPWPDPPSGTGCFGLSGCSLLLLQVMHAACLL

SEQ ID NO: 501 - protein, 1253 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSRNPVRLLQPRAQMFCVLRGTK

SEQ ID NO: 502 - protein, 843 aa, Homo sapiens; identical to SEQ ID NO: 489

SEQ ID NO: 503 - protein, 394 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQVSSRGEG

SEQ ID NO: 504 - protein, 263 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYAGEWTEPHFPLKGRVPGRPGEAEYGHY

SEQ ID NO: 505 - protein, 1533 aa, Homo sapiens; identical to SEQ ID NO: 495

SEQ ID NO: 506 - protein, 1555 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWWAPGAALGQGREGRTQAGAGLLEPAQAEPGRQLTRLHRRNGKVGLSGMAIADVTLLSGFHALRADLEKVWSATQGNPLCPRY

SEQ ID NO: 507 - DNA, 1266 bp, Homo sapiens
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtggaaagtgcatcttcctaagggcgagggtttcagcagtggttgaactcggcggggtggggcggagcgggaggatgcaaacttgcaaagtgaagcaaacacactcaccgcagcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggcaaa

SEQ ID NO: 508 - DNA, 747 bp, Homo sapiens
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccga

SEQ ID NO: 509 - DNA, 359 bp, Artificial
  Synthetic oligonucleotide
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgt

SEQ ID NO: 510 - DNA, 586 bp, Artificial
  Synthetic oligonucleotide
ctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggcaaa

SEQ ID NO: 511 - DNA, 111 bp, Artificial
  Synthetic oligonucleotide
ggaaagtgcatcttcctaagggcgagggtttcagcagtggttgaactcggcggggtggggcggagcgggaggatgcaaacttgcaaagtgaagcaaacacactcaccgcag

SEQ ID NO: 512 - DNA, 44 bp, Artificial
  Synthetic oligonucleotide
cccagcaagggctctggcagctgacagggctttgtctgggacag

SEQ ID NO: 513 - DNA, 97 bp, Artificial
  Synthetic oligonucleotide
ctgcaaaccagtgtgccgtgccagccaaggacagggtggactgcggctacccccatgtcacccccaaggagtgcaacaaccggggctgctgctttga

SEQ ID NO: 514 - DNA, 50 bp, Artificial
  Synthetic oligonucleotide
ctccaggatccctggagtgccttggtgtttcaagcccctgcaggaagcag

SEQ ID NO: 515 - DNA, 19 bp, Artificial
  Synthetic oligonucleotide
aatgcaccttctgaggcac

SEQ ID NO: 516 - protein, 80 aa, Homo sapiens
MAARALCMLGLVLALLSSSSAEEYVGLSANQCAVPAKDRVDCGYPHVTPKECNNRGCCFDSRIPGVPWCFKPLQEAECTF

SEQ ID NO: 517 - protein, 137 aa, Homo sapiens
MAARALCMLGLVLALLSSSSAEEYVGLSQQGLWQLTGLCLGQLQTSVPCQPRTGWTAATPMSPPRSATTGAAALTPGSLECLGVSSPCRKQNAPSEAPPAAPGRGMRGSEHPCPAVIAARHCSSQLFCPFAPGKRFC

SEQ ID NO: 518 - protein, 41 aa, Homo sapiens [sequence omitted]

SEQ ID NO: 519 - DNA, 1846 bp, Homo sapiens
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacaggtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataaga

SEQ ID NO: 520 - DNA, 1769 bp, Homo sapiens
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagcactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaactttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataaga

SEQ ID NO: 521 - DNA, 378 bp, Homo sapiens
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcaggtaagcatcttttatgtttttatatagttaaatcatttactcaattatggcgagaggtgcaagaaacgtatttgctgcgatattact

SEQ ID NO: 522 - DNA, 184 bp, Artificial
  Synthetic oligonucleotide
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaag

SEQ ID NO: 523 - DNA, 189 bp, Artificial
  Synthetic oligonucleotide
cactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaa

SEQ ID NO: 524 - DNA, 266 bp, Artificial
  Synthetic oligonucleotide
gtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcag

SEQ ID NO: 525 - DNA, 164 bp, Artificial
  Synthetic oligonucleotide
actgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgag

SEQ ID NO: 526 - DNA, 230 bp, Artificial
  Synthetic oligonucleotide
agtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatc

SEQ ID NO: 527 - DNA, 136 bp, Artificial
  Synthetic oligonucleotide
tggtgtgaataaatcttttatcttgaatgtaataagaatttggtggtgtcaattgcttatttgttttcccacggttgtccagcaattaataaaacataaccttttttactgcctatataatgtttttaaaggttta

SEQ ID NO: 528 - DNA, 26 bp, Artificial
  Synthetic oligonucleotide
gaaaactcactaccatgagaattgca

SEQ ID NO: 529 - DNA, 42 bp, Artificial
  Synthetic oligonucleotide
gtgatttgcttttgcctcctaggcatcacctgtgccatacca

SEQ ID NO: 530 - DNA, 39 bp, Artificial
  Synthetic oligonucleotide
gttaaacaggctgattctggaagttctgaggaaaagcag

SEQ ID NO: 531 - DNA, 87 bp, Artificial
  Synthetic oligonucleotide
gtaagcatcttttatgtttttatatagttaaatcatttactcaattatggcgagaggtgcaagaaacgtatttgctgcgatattact

SEQ ID NO: 532 - DNA, 81 bp, Artificial
  Synthetic oligonucleotide
ctttacaacaaatacccagatgctgtggccacatggctaaaccctgacccatctcagaagcagaatctcctagccccacag

SEQ ID NO: 533 - DNA, 42 bp, Artificial
  Synthetic oligonucleotide
aatgctgtgtcctctgaagaaaccaatgactttaaacaagag

SEQ ID NO: 534 - DNA, 8 bp, Artificial
  Synthetic oligonucleotide
acccttcc

SEQ ID NO: 535 - DNA, 50 bp, Artificial
  Synthetic oligonucleotide
aagtaagtccaacgaaagccatgaccacatggatgatatggatgatgaag

SEQ ID NO: 536 - DNA, 65 bp, Artificial
  Synthetic oligonucleotide
atgatgatgaccatgtggacagccaggactccattgactcgaacgactctgatgatgtagatgac

SEQ ID NO: 537 - DNA, 37 bp, Artificial
  Synthetic oligonucleotide
gtcaaaatctaagaagtttcgcagacctgacatccag

SEQ ID NO: 538 - DNA, 18 bp, Artificial
  Synthetic oligonucleotide
taccctgatgctacagac

SEQ ID NO: 539 - DNA, 26 bp, Artificial
  Synthetic oligonucleotide
gaggacatcacctcacacatggaaag

SEQ ID NO: 540 - DNA, 52 bp, Artificial
  Synthetic oligonucleotide
cgaggagttgaatggtgcatacaaggccatccccgttgcccaggacctgaac

SEQ ID NO: 541 - DNA, 51 bp, Artificial
  Synthetic oligonucleotide
gcgccttctgattgggacagccgtgggaaggacagttatgaaacgagtcag

SEQ ID NO: 542 - DNA, 12 bp, Artificial
  Synthetic oligonucleotide
ctggatgaccag

SEQ ID NO: 543 - DNA, 34 bp, Artificial
  Synthetic oligonucleotide
ttctgaggtcaattaaaaggagaaaaaatacaat

SEQ ID NO: 544 - DNA, 41 bp, Artificial
  Synthetic oligonucleotide
ttctcactttgcatttagtcaaaagaaaaaatgctttatag

SEQ ID NO: 545 - DNA, 36 bp, Artificial
  Synthetic oligonucleotide
caaaatgaaagagaacatgaaatgcttctttctcag

SEQ ID NO: 546 - DNA, 119 bp, Artificial
  Synthetic oligonucleotide
tttattggttgaatgtgtatctatttgagtctggaaataactaatgtgtttgataattagtttagtttgtggcttcatggaaactccctgtaaactaaaagcttcagggttatgtctat

SEQ ID NO: 547 - DNA, 11 bp, Artificial
  Synthetic oligonucleotide
gttcattctat

SEQ ID NO: 548 - DNA, 91 bp, Artificial
  Synthetic oligonucleotide
agaagaaatgcaaactatcactgtattttaatatttgttattctctcatgaatagaaatttatgtagaagcaaacaaaatacttttaccca

SEQ ID NO: 549 - DNA, 18 bp, Artificial
  Synthetic oligonucleotide
cttaaaaagagaatataa

SEQ ID NO: 550 - DNA, 6 bp, Artificial
  Synthetic oligonucleotide
catttt

SEQ ID NO: 551 - DNA, 60 bp, Artificial
  Synthetic oligonucleotide
atgtcactataatcttttgttttttaagttagtgtatattttgttgtgattatctttttg

SEQ ID NO: 552 - protein, 314 aa, Homo sapiens
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 553 - protein, 64 aa, Homo sapiens
MRIAVICFCLLGITCAIPVKQADSGSSEEKQLYNKYPDAVATWLNPDPSQKQNLLAPQVFLNFS

SEQ ID NO: 554 - protein, 32 aa, Homo sapiens
MRIAVICFCLLGITCAIPVKQADSGSSEEKQH

SEQ ID NO: 555 - protein, 39 aa, Homo sapiens
MRIAVICFCLLGITCAIPVKQADSGSSEEKQVSIFYVFI

SEQ ID NO: 556 - DNA, 1295 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccggttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 557 - DNA, 1367 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 558 - DNA, 1520 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 559 - DNA, 1371 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacagggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 560 - DNA, 2213 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 561 - DNA, 2247 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggtgagaatacccagaggccagcagccgaggccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 562 - DNA, 153 bp, Artificial
  Synthetic oligonucleotide
acactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctccca

SEQ ID NO: 563 - DNA, 744 bp, Artificial
  Synthetic oligonucleotide
ggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 564 - DNA, 174 bp, Artificial
  Synthetic oligonucleotide
gtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactg

SEQ ID NO: 565 - DNA, 309 bp, Artificial
  Synthetic oligonucleotide
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgt

SEQ ID NO: 566 - DNA, 487 bp, Artificial
  Synthetic oligonucleotide
gtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgc

SEQ ID NO: 567 - DNA, 418 bp, Artificial
  Synthetic oligonucleotide
ggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccataaatctggttttgtctttttttgttttaaagaaaaagatgtatacatacagtatagctgcattagataaagcagtgtttgtattttaaaggatgtctgcacaa

SEQ ID NO: 568 - DNA, 44 bp, Artificial
  Synthetic oligonucleotide
gctttgcgctgcaaatccagtgctaccagtgtgaagaattccag

SEQ ID NO: 569 - DNA, 94 bp, Artificial
  Synthetic oligonucleotide
ctgaacaacgactgctcctcccccgagttcattgtgaattgcacggtgaacgttcaagacatgtgtcagaaagaagtgatggagcaaagtgccg

SEQ ID NO: 570 - DNA, 4 bp, Artificial
  Synthetic oligonucleotide
acag

SEQ ID NO: 571 - DNA, 58 bp, Artificial
  Synthetic oligonucleotide
ggatcatgtaccgcaagtcctgtgcatcatcagcggcctgtctcatcgcctctgccgg

SEQ ID NO: 572 - DNA, 11 bp, Artificial
  Synthetic oligonucleotide
ctgaagctgaa

SEQ ID NO: 573 - DNA, 63 bp, Artificial
  Synthetic oligonucleotide
ggagatgccaccccctcctgcattgttcttccagccctcgcccccaaccccccacctccctga

SEQ ID NO: 574 - DNA, 30 bp, Artificial
  Synthetic oligonucleotide
tctgaaaagtgcttaagaaaatcttctcag

SEQ ID NO: 575 - DNA, 84 bp, Artificial
  Synthetic oligonucleotide
ttctccttgcagaggactggcgccgggacgcgaagagcaacgggcgctgcacaaagcgggcgctgtcggtggtggagtgcgcat

SEQ ID NO: 576 - DNA, 26 bp, Artificial
  Synthetic oligonucleotide
gtacgcgcaggcgcttctcgtggttg

SEQ ID NO: 577 - DNA, 113 bp, Artificial
  Synthetic oligonucleotide
gcgtgctgcagcgacaggcggcagcacagcacctgcacgaacacccgccgaaactgctgcgaggacaccgtgtacaggagcgggttgatgaccgagctgaggtagaaaaacgt

SEQ ID NO: 578 - DNA, 82 bp, Artificial
  Synthetic oligonucleotide
ctccgagaaggggaggaggatcatgtacgcccggaagtaggacctcgtccagtcgtgcttgggtttggccgcagccatgatc

SEQ ID NO: 579 - DNA, 24 bp, Artificial
  Synthetic oligonucleotide
ctccgaatctggttgggcatccag

SEQ ID NO: 580 - DNA, 28 bp, Artificial
  Synthetic oligonucleotide
catacggccaatgtcacaacaatcagcc

SEQ ID NO: 581 - DNA, 10 bp, Artificial
  Synthetic oligonucleotide
ctccgcggca

SEQ ID NO: 582 - DNA, 21 bp, Artificial
  Synthetic oligonucleotide
ctgggcagacacgagcaggag

SEQ ID NO: 583 - DNA, 52 bp, Artificial
  Synthetic oligonucleotide
gcagcgcgggccccagcagcctcggcagccacagccgctgcagccggggcag

SEQ ID NO: 584 - DNA, 43 bp, Artificial
  Synthetic oligonucleotide
cctccgctgctgtcgcctcctctgatgcgcttgccctctcccg

SEQ ID NO: 585 - DNA, 32 bp, Artificial
  Synthetic oligonucleotide
gccccgggactccgggagaatgtgggtcctag

SEQ ID NO: 586 - DNA, 39 bp, Artificial
  Synthetic oligonucleotide
gcatcgcggcaactttttgcggattgttcttgcttccag

SEQ ID NO: 587 - DNA, 34 bp, Artificial
  Synthetic oligonucleotide
gtgagaatacccagaggccagcagccgaggccag

SEQ ID NO: 588 - protein, 112 aa, Homo sapiens
MYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 589 - protein, 222 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGSPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 590 - protein, 93 aa, Homo sapiens
MWVLGIAATFCGLFLLPGFALQIQCYQCEEFQLNNDCSSPEFIVNCTVNVQDMCQKEVMEQSAGSHCVTRLECSGTISAHCNLCLPGSNDHPT

SEQ ID NO: 591 - protein, 84 aa, Homo sapiens
MWVLGIAATFCGLFLLPGFALQIQCYQCEEFQLNNDCSSPEFIVNCTVNVQDMCQKEVMEQSADTKRTNTLLFEMRHFAKQLTT

SEQ ID NO: 592 - protein, 90 aa, Homo sapiens
MWVLGIAATFCGLFLLPGFALQIQCYQCEEFQLNNDCSSPEFIVNCTVNVQDMCQKEVMEQSADRVSLCHEAGVQWNNFSTLQPLPPRLK

SEQ ID NO: 593 - DNA, 3750 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaacttacctttgtgagtgctagtatctgtgaatttctataaacattatacaggaaggccgttttcatattatagcaggcactatcggggttacatagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggggaagggcttgcagaagagctcaaggtgctttcagtgcaatgggagcggttgtgttttgccagagcacctgaatcctgtcaaaagcaggaggtgatgagcttggaaaggtagcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcagctaatggatcagaagtgattgggactgcctggagctttttttcagttatggtcttagatgtgagtcagagaatattatctattgagtttcacccacttctctgcccctgtgcttttacagactgtccttatttttctaggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 594 - DNA, 3144 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagatatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 595 - DNA, 2544 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 596 - DNA, 2575 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtgctaatggatcagaagtgattgggactgcctggagctttttttcagttatggtcttagatgctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 597 - DNA, 3529 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagaggtaaggccagacatgagccagggatctagagtagggttagaaatactcagctctgccggcctagctctttgaagggtaggtggcaaaatgatttgtgttcttaggggcaagtctgacaccctaatctagcccagtacaggaagccagaagcactttgaagtcagaaaagagccttagtggtcagctttgaatgtattacaaccattgtaattgatgccccaatacaatagaatgagagaggaaaattattagctttatgaagatgaaaatgcattcatagatgtggcagaagattaatttgttagctgtgtaaaaattctctgctgctacagagaatcctgccctgccctccccaccctcaacatgtccccgagagctgctcctctgtaaccctcacagctccaggagcttgtcccggaagcacgaggtctgtgttatttcccacagaagctgcagcaggttttgcagaggctcccagcaaggagtatctcctcagtagcctacaccatctccccgggacccagacaaccttagagtcacatggatggtcagacagaccttgacatgagggcagcttgctggcagcttgactttctaaacagaattggaggcaaatttaaatgtcacaaaggtgtttctcattgatttgactttattagaacctgagtgatttcagacacacaaaggccagtaagaacagaattgctttcacctctggaaatcgttttcagatgtgccgctttcttctatccaggacgtttgctggaagaatgtaactcaatagtgtaccctcaacgtggctgccagttagggtgctgggatcagagagaggctttttcagggagaccatcagtgggtgggagaagatgtctcatctccacccgagtctccattgtgagctttctgagcatttcaccatggagactcggcacagacgtgttccttggctttcctgtaggaatccagggcccaccagagcttcccttagcaccagcagtggcagctggttcattttgccaccctccagtagccttttcctggtggttctgcattgtacctgagaaagagccaggactcagttgcttttgcaaagcagaaccctgttcccttgcagcacctgcctgggcccccagggagccaaaagactgctctgctgagttctctcttttctggaagttgctcactcgagaagaatgaaatctgcccgccatggtggcttatgcctataatcccagcactttgggaggctaaggcgggaggatcgcttgagctcaggagttggagaccagcctgggcaacatagtgagacctcgtctctcaaaaaattaata

SEQ ID NO: 598 - DNA, 2433 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 599 - DNA, 4378 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagatatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaacttacctttgtgagtgctagtatctgtgaatttctataaacattatacaggaaggccgttttcatattatagcaggcactatcggggttacatagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggggaagggcttgcagaagagctcaaggtgctttcagtgcaatgggagcggttgtgttttgccagagcacctgaatcctgtcaaaagcaggaggtgatgagcttggaaaggtagcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcagctaatggatcagaagtgattgggactgcctggagctttttttcagttatggtcttagatgtgagtcagagaatattatctattgagtttcacccacttctctgcccctgtgcttttacagactgtccttatttttctaggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 600 - DNA, 3654 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaacttacctttgtgagtgctagtatctgtgaatttctataaacattatacaggaaggccgttttcatattatagcaggcactatcggggttacatagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggggaagggcttgcagaagagctcaaggtgctttcagtgcaatgggagcggttgtgttttgccagagcacctgaatcctgtcaaaagcaggaggtgatgagcttggaaaggtagcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcagctaatggatcagaagtgattgggactgcctggagctttttttcagttatggtcttagatgtgagtcagagaatattatctattgagtttcacccacttctctgcccctgtgcttttacagactgtccttatttttctaggctgatgtggtcatcaagttccctgaggaagaagctccctcgactgtcttgtcccagaaccttttcactccaaaacaggaaattcagtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 601 - DNA, 2334 bp, Homo sapiens
gtacctgggactatgggtgcatcccaccgcaccccgctgttagctgataatcctgcaggtcagaagtctagacaggcttgcctgggccctctgcttagtgtctcctgaggtcaaagtgaaggcattggccaaactgggctcctcccggaagcactggagaagaatctgcctccaggcccattcatgttgtcgtattgtcagcaaaatccagttcctgtggttgtgggcctgaggtctccatttccttgctagctgtctgctaggagttgctctctgttcctcaaggccattggtatttcttctcacatggcccctccacctttaaaccagtaatggcatgaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 602 - DNA, 2340 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 603 - DNA, 2086 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgcctttggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 604 - DNA, 2244 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 605 - DNA, 1717 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagggccaggtgaggtggctcacacctgtaatcccagcactttgggaggccaaggcaggcggatcacctgaggtcaggagttcaatactagcctggccaacatgatgaaaccccatctctactaaaaacacaaaaagtagccaggcgtggtggcacgtgcctgtaatcccagctactcgggaggctgaagcaggagaatcgcttgaacctgggaggtggaggttgcagtgagctgagatcgtgccaccgcactccagcctgggcaatggagccagactctgtctcaaaaaaataaataaataaataaaataca

SEQ ID NO: 606 - DNA, 1501 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtagggtaagtcctgatcatattttggtggggcgctgacctctttgttttggaaagttagcctgcagccagtgtaacagattaatacattccagttaggtaaatttgatctactggtatcgaaagcctacagtcgaatgtaagaaaatgatttttaaaatgaagattatttggttttactgtttcattctctgtttctagttggc

SEQ ID NO: 607 - DNA, 1522 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 608 - DNA, 1836 bp, Homo sapiens
tgctggctctgtcaccctgccaactcatttaatgcttgtgccttgtgatctgtaaattggatctgtaaacctacctgccttgttgaattctttattttgaaacacctgaaagaaaagctctgggtagttatcaagttttggtccagttctaatgtgcagacaccttggtttcttgtgccattagtggggataaagtgattagactcagtaccatcgtattgctattaactactatttgttgactagctagcatataccgttccctgcactaatgcttagcatatggtattgcaaatcttcacacagatatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 609 - DNA, 1275 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcatggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 610 - DNA, 1718 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgtgagttgtcatctcgagcatttctcaggcttcatttgtctcgggtcctatccgaagagggctcattcattggttcagcaaatactttctgggcaagtacttgcagtaaatacttccgtgtgccaggtgctctgcaaggcaccgcagacatgattgcatgaaggcaagtaaggtccgtgtcctcgtggagctcacatggacacagtcttctgcaagcctcgcagacagaaggcaagcgctgagccagagcatgagcacaccaccacctagagatccagttgccttgtgcggttggagggctagagcaagggcagataactgagaaggagccacgtgcatgtcttgttgaggcttggctagggcaggatgacatgttggcagtggaggctctgcaaagtgggggctctcaggatccctggaagttgtgaaagacagcatctggtgggtgaggtggttgctcagagggtggagtattctaggaatcagactctactactctgcaaaaggcttaggtgaaggagaagcacctttcctatttgttataaatggaaatattgtaacttcagggtgttttttgctaagctcttaaagtgataaatataatgtagttttaaaatttttaatttaatttagagacacggaatctcaactctgtcaacccaaggctgaaagtgcaaatggtaatgaatcaaaactcactgcagccttgaaactctgggctcaaagtgaattttcctaacctcaagcctcccgagtaagctggaactacaaggtgcaaaactaccacagcctagctaatttttttttttttttgagacgtggtcttactctgttacccaggctagagtgcagtgacgcgatctcagttcactgcaacctccgcctcccgggttcaagcagttctcctgcctcagcgtcttcagt

SEQ ID NO: 611 - DNA, 872 bp, Homo sapiens
ttcagtgggggtgtcagttaccttataaatgcagtttctgacctttcagcttcatggtctcacctgttttaaaatagtagggtttgtcatcattaaaaatgatgttcaggtttgagttacacgagcccatttgagagcaggtgctgaatgcctttctaaagaaaaagggaacaagtttccccgagggcttataatagggtggttgtcacttggaagaattgcctgtccttctaggatgcatgaactttgaagccttggggctgttgatgggattagcattggcatggcttgtgttgcttcccttttaagttctaatgcctttttaatttatttctccccatcattcagtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 612 - DNA, 1375 bp, Homo sapiens
ttgagatggagtcttgctctgtctcgcccaggctggagtgcaacggtgcgatcttggctcactgcagcctctgcctcccaggttcaggcgattctcccacctcagcctcccaagtagctgggattataggcctgcgccaccacacctggctaattttatatttttagtagagagagggtttcaccatgttggccagggtggtctcgaatgcctgacctcaagtgatccttctgcctcggcctcccaaagtgctgggattacaggtgtgagctcccgcacccagcctatttatatcctgtgtatttttgttaagaatttgaaaaatgaatgccaagtataacatgacagaggagttttaaacaaaagcagagaaatagttgtaagcaggaacatggcacaggtcgctgaagtccaattgttacccctgtttgtgggtgtgtgtgtgggtgtgtgtgtgttttgagacgaggtatcactgtcacccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcaatcctcctgcctcagcctcccaaaatgttgggattacaggtgtgagccactgtgcctggccacacacttggccacagctgagaggcgaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 613 - DNA, 1602 bp, Homo sapiens
ttgagatggagtcttgctctgtctcgcccaggctggagtgcaacggtgcgatcttggctcactgcagcctctgcctcccaggttcaggcgattctcccacctcagcctcccaagtagctgggattataggcctgcgccaccacacctggctaattttatatttttagtagagagagggtttcaccatgttggccagggtggtctcgaatgcctgacctcaagtgatccttctgcctcggcctcccaaagtgctgggattacaggtgtgagctcccgcacccagcctatttatatcctgtgtatttttgttaagaatttgaaaaatgaatgccaagtataacatgacagaggagttttaaacaaaagcagagaaatagttgtaagcaggaacatggcacaggtcgctgaagtccaattgttacccctgtttgtgggtgtgtgtgtgggtgtgtgtgtgttttgagacgaggtatcactgtcacccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcaatcctcctgcctcagcctcccaaaatgttgggattacaggtgtgagccactgtgcctggccacacacttggccacagctgagaggcgaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaaaaaaaaaagattgagagcttattctcatacttttgggtggtggggtccttgggtatatgacatgaggacttagttggaaatgctgttgatgccagcatatttctccaggcctttcttggtccttcttgccccttgctcctaacagaactgagaactgcctggaaaggccagcttccttttttcttctccagcagtgagcaccagctgtctgcataggagccctgttg

SEQ ID NO: 614 - DNA, 328 bp, Artificial
  Synthetic oligonucleotide
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgg

SEQ ID NO: 615 - DNA, 194 bp, Artificial
  Synthetic oligonucleotide
gttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaag

SEQ ID NO: 616 - DNA, 340 bp, Artificial
  Synthetic oligonucleotide
gtacctgggactatgggtgcatcccaccgcaccccgctgttagctgataatcctgcaggtcagaagtctagacaggcttgcctgggccctctgcttagtgtctcctgaggtcaaagtgaaggcattggccaaactgggctcctcccggaagcactggagaagaatctgcctccaggcccattcatgttgtcgtattgtcagcaaaatccagttcctgtggttgtgggcctgaggtctccatttccttgctagctgtctgctaggagttgctctctgttcctcaaggccattggtatttcttctcacatggcccctccacctttaaaccagtaatggcatg

SEQ ID NO: 617 - DNA, 133 bp, Artificial
  Synthetic oligonucleotide
atctctatttcaaatgagaccaaagatctgcttctggcagctgtcagtgaggactcatctgttacccagatctaccatgcagttgcagctctaagtggctttggccttcccttggcatcccaagaagcactca

SEQ ID NO: 618 - DNA, 924 bp, Artificial
  Synthetic oligonucleotide
gtgagttgtcatctcgagcatttctcaggcttcatttgtctcgggtcctatccgaagagggctcattcattggttcagcaaatactttctgggcaagtacttgcagtaaatacttccgtgtgccaggtgctctgcaaggcaccgcagacatgattgcatgaaggcaagtaaggtccgtgtcctcgtggagctcacatggacacagtcttctgcaagcctcgcagacagaaggcaagcgctgagccagagcatgagcacaccaccacctagagatccagttgccttgtgcggttggagggctagagcaagggcagataactgagaaggagccacgtgcatgtcttgttgaggcttggctagggcaggatgacatgttggcagtggaggctctgcaaagtgggggctctcaggatccctggaagttgtgaaagacagcatctggtgggtgaggtggttgctcagagggtggagtattctaggaatcagactctactactctgcaaaaggcttaggtgaaggagaagcacctttcctatttgttataaatggaaatattgtaacttcagggtgttttttgctaagctcttaaagtgataaatataatgtagttttaaaatttttaatttaatttagagacacggaatctcaactctgtcaacccaaggctgaaagtgcaaatggtaatgaatcaaaactcactgcagccttgaaactctgggctcaaagtgaattttcctaacctcaagcctcccgagtaagctggaactacaaggtgcaaaactaccacagcctagctaatttttttttttttttgagacgtggtcttactctgttacccaggctagagtgcagtgacgcgatctcagttcactgcaacctccgcctcccgggttcaagcagttctcctgcctcagcgtcttcagt

SEQ ID NO: 619 - DNA, 166 bp, Artificial
  Synthetic oligonucleotide
gatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacagg

SEQ ID NO: 620 - DNA, 200 bp, Artificial
  Synthetic oligonucleotide
gtaagtcctgatcatattttggtggggcgctgacctctttgttttggaaagttagcctgcagccagtgtaacagattaatacattccagttaggtaaatttgatctactggtatcgaaagcctacagtcgaatgtaagaaaatgatttttaaaatgaagattatttggttttactgtttcattctctgtttctagttggc

SEQ ID NO: 621 - DNA, 310 bp, Artificial
  Synthetic oligonucleotide
ggccaggtgaggtggctcacacctgtaatcccagcactttgggaggccaaggcaggcggatcacctgaggtcaggagttcaatactagcctggccaacatgatgaaaccccatctctactaaaaacacaaaaagtagccaggcgtggtggcacgtgcctgtaatcccagctactcgggaggctgaagcaggagaatcgcttgaacctgggaggtggaggttgcagtgagctgagatcgtgccaccgcactccagcctgggcaatggagccagactctgtctcaaaaaaataaataaataaataaaataca

SEQ ID NO: 622 - DNA, 306 bp, Artificial
  Synthetic oligonucleotide
tgctggctctgtcaccctgccaactcatttaatgcttgtgccttgtgatctgtaaattggatctgtaaacctacctgccttgttgaattctttattttgaaacacctgaaagaaaagctctgggtagttatcaagttttggtccagttctaatgtgcagacaccttggtttcttgtgccattagtggggataaagtgattagactcagtaccatcgtattgctattaactactatttgttgactagctagcatataccgttccctgcactaatgcttagcatatggtattgcaaatcttcacacag

SEQ ID NO: 623 - DNA, 628 bp, Artificial
  Synthetic oligonucleotide
atatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctag

SEQ ID NO: 624 - DNA, 1067 bp, Artificial
  Synthetic oligonucleotide
gtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaacttacctttgtgagtgctagtatctgtgaatttctataaacattatacaggaaggccgttttcatattatagcaggcactatcggggttacatagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggggaagggcttgcagaagagctcaaggtgctttcagtgcaatgggagcggttgtgttttgccagagcacctgaatcctgtcaaaagcaggaggtgatgagcttggaaaggtagcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcag

SEQ ID NO: 625 - DNA, 348 bp, Artificial
  Synthetic oligonucleotide
ttcagtgggggtgtcagttaccttataaatgcagtttctgacctttcagcttcatggtctcacctgttttaaaatagtagggtttgtcatcattaaaaatgatgttcaggtttgagttacacgagcccatttgagagcaggtgctgaatgcctttctaaagaaaaagggaacaagtttccccgagggcttataatagggtggttgtcacttggaagaattgcctgtccttctaggatgcatgaactttgaagccttggggctgttgatgggattagcattggcatggcttgtgttgcttcccttttaagttctaatgcctttttaatttatttctccccatcattcag

SEQ ID NO: 626 - DNA, 927 bp, Artificial
  Synthetic oligonucleotide
ttgagatggagtcttgctctgtctcgcccaggctggagtgcaacggtgcgatcttggctcactgcagcctctgcctcccaggttcaggcgattctcccacctcagcctcccaagtagctgggattataggcctgcgccaccacacctggctaattttatatttttagtagagagagggtttcaccatgttggccagggtggtctcgaatgcctgacctcaagtgatccttctgcctcggcctcccaaagtgctgggattacaggtgtgagctcccgcacccagcctatttatatcctgtgtatttttgttaagaatttgaaaaatgaatgccaagtataacatgacagaggagttttaaacaaaagcagagaaatagttgtaagcaggaacatggcacaggtcgctgaagtccaattgttacccctgtttgtgggtgtgtgtgtgggtgtgtgtgtgttttgagacgaggtatcactgtcacccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcaatcctcctgcctcagcctcccaaaatgttgggattacaggtgtgagccactgtgcctggccacacacttggccacagctgagaggcgaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgctg

SEQ ID NO: 627 - DNA, 1331 bp, Artificial
  Synthetic oligonucleotide
gtaaggccagacatgagccagggatctagagtagggttagaaatactcagctctgccggcctagctctttgaagggtaggtggcaaaatgatttgtgttcttaggggcaagtctgacaccctaatctagcccagtacaggaagccagaagcactttgaagtcagaaaagagccttagtggtcagctttgaatgtattacaaccattgtaattgatgccccaatacaatagaatgagagaggaaaattattagctttatgaagatgaaaatgcattcatagatgtggcagaagattaatttgttagctgtgtaaaaattctctgctgctacagagaatcctgccctgccctccccaccctcaacatgtccccgagagctgctcctctgtaaccctcacagctccaggagcttgtcccggaagcacgaggtctgtgttatttcccacagaagctgcagcaggttttgcagaggctcccagcaaggagtatctcctcagtagcctacaccatctccccgggacccagacaaccttagagtcacatggatggtcagacagaccttgacatgagggcagcttgctggcagcttgactttctaaacagaattggaggcaaatttaaatgtcacaaaggtgtttctcattgatttgactttattagaacctgagtgatttcagacacacaaaggccagtaagaacagaattgctttcacctctggaaatcgttttcagatgtgccgctttcttctatccaggacgtttgctggaagaatgtaactcaatagtgtaccctcaacgtggctgccagttagggtgctgggatcagagagaggctttttcagggagaccatcagtgggtgggagaagatgtctcatctccacccgagtctccattgtgagctttctgagcatttcaccatggagactcggcacagacgtgttccttggctttcctgtaggaatccagggcccaccagagcttcccttagcaccagcagtggcagctggttcattttgccaccctccagtagccttttcctggtggttctgcattgtacctgagaaagagccaggactcagttgcttttgcaaagcagaaccctgttcccttgcagcacctgcctgggcccccagggagccaaaagactgctctgctgagttctctcttttctggaagttgctcactcgagaagaatgaaatctgcccgccatggtggcttatgcctataatcccagcactttgggaggctaaggcgggaggatcgcttgagctcaggagttggagaccagcctgggcaacatagtgagacctcgtctctcaaaaaattaata

SEQ ID NO: 628 - DNA, 486 bp, Artificial
  Synthetic oligonucleotide
gagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaaaaaaaaaagattgagagcttattctcatacttttgggtggtggggtccttgggtatatgacatgaggacttagttggaaatgctgttgatgccagcatatttctccaggcctttcttggtccttcttgccccttgctcctaacagaactgagaactgcctggaaaggccagcttccttttttcttctccagcagtgagcaccagctgtctgcataggagccctgttg

SEQ ID NO: 629 - DNA, 96 bp, Artificial
  Synthetic oligonucleotide
aaagcatgtacctacatcagatctaaccttgatcccagcaatgtggattccctcttctacgctgcccaggccagccaggccctctcaggatgtgag

SEQ ID NO: 630 - DNA, 43 bp, Artificial
  Synthetic oligonucleotide
gtgcccttactgctcgtctcagcaaggaggagactgtgctggc

SEQ ID NO: 631 - DNA, 76 bp, Artificial
  Synthetic oligonucleotide
aacagtccaggctctgcagacagcatcccacctgtcccagcaggctgacctgaggagcatcgtggaggagattgag

SEQ ID NO: 632 - DNA, 105 bp, Artificial
  Synthetic oligonucleotide
gaccttgttgctcgcctggatgaactcgggggcgtgtatctccagtttgaagaaggactggaaacaacagcgttatttgtggctgccacctacaagctcatggat

SEQ ID NO: 633 - DNA, 30 bp, Artificial
  Synthetic oligonucleotide
catgtggggactgagccatccattaaggag

SEQ ID NO: 634 - DNA, 11 bp, Artificial
  Synthetic oligonucleotide
ctatcttgcgg

SEQ ID NO: 635 - DNA, 119 bp, Artificial
  Synthetic oligonucleotide
ttgcaagtcaccaatgttctgtctcagcctctgactcaggccactgttaaactagaacatgctaaatctgttgcttccagagccactgtcctccagaagacatccttcacccctgtagg

SEQ ID NO: 636 - DNA, 28 bp, Artificial
  Synthetic oligonucleotide
ggatgtttttgaactaaatttcatgaac

SEQ ID NO: 637 - DNA, 78 bp, Artificial
  Synthetic oligonucleotide
gtcaaattttccagtggttattatgacttccttgtcgaagttgaaggtgacaaccggtatattgcaaataccgtagag

SEQ ID NO: 638 - DNA, 5 bp, Artificial
  Synthetic oligonucleotide
ctcag

SEQ ID NO: 639 - DNA, 23 bp, Artificial
  Synthetic oligonucleotide
agtcaagatctccactgaagttg

SEQ ID NO: 640 - DNA, 64 bp, Artificial
  Synthetic oligonucleotide
gcatcacaaatgttgatctttccaccgtggataaggatcagagcattgcacccaaaactacccg

SEQ ID NO: 641 - DNA, 63 bp, Artificial
  Synthetic oligonucleotide
ggtgacatacccagccaaagccaagggcacattcatcgcagacagccaccagaacttcgcctt

SEQ ID NO: 642 - DNA, 52 bp, Artificial
  Synthetic oligonucleotide
gttcttccagctggtagatgtgaacactggtgctgaactcactcctcaccag

SEQ ID NO: 643 - DNA, 101 bp, Artificial
  Synthetic oligonucleotide
acatttgtccgactccataaccagaagactggccaggaagtggtgtttgttgccgagccagacaacaagaacgtgtacaagtttgaactggatacctctga

SEQ ID NO: 644 - DNA, 42 bp, Artificial
  Synthetic oligonucleotide
aagaaagattgaatttgactctgcctctggcacctacactct

SEQ ID NO: 645 - DNA, 52 bp, Artificial
  Synthetic oligonucleotide
ctacttaatcattggagatgccactttgaagaacccaatcctctggaatgtg

SEQ ID NO: 646 - DNA, 28 bp, Artificial
  Synthetic oligonucleotide
gtatgtgcctgaatgtaccccgacccag

SEQ ID NO: 647 - DNA, 59 bp, Artificial
  Synthetic oligonucleotide
ctaatggatcagaagtgattgggactgcctggagctttttttcagttatggtcttagat

SEQ ID NO: 648 - DNA, 80 bp, Artificial
  Synthetic oligonucleotide
gtgagtcagagaatattatctattgagtttcacccacttctctgcccctgtgcttttacagactgtccttatttttctag

SEQ ID NO: 649 - DNA, 67 bp, Artificial
  Synthetic oligonucleotide
gctgatgtggtcatcaagttccctgaggaagaagctccctcgactgtcttgtcccagaaccttttca

SEQ ID NO: 650 - DNA, 20 bp, Artificial
  Synthetic oligonucleotide
ctccaaaacaggaaattcag

SEQ ID NO: 651 - DNA, 35 bp, Artificial
  Synthetic oligonucleotide
cacctgttccgcgagcctgagaagaggccccccac

SEQ ID NO: 652 - DNA, 61 bp, Artificial
  Synthetic oligonucleotide
cgtggtgtccaatacattcactgccctgatcctctcgccgttgcttctgctcttcgctctg

SEQ ID NO: 653 - DNA, 35 bp, Artificial
  Synthetic oligonucleotide
tggatccggattggtgccaatgtctccaacttcac

SEQ ID NO: 654 - DNA, 41 bp, Artificial
  Synthetic oligonucleotide
ttttgctcctagcacgattatatttcacctgggacatgctg

SEQ ID NO: 655 - DNA, 75 bp, Artificial
  Synthetic oligonucleotide
ctatgctgggactcatgtatgtctactggactcagctcaacatgttccagaccttgaagtacctggccatcttgg

SEQ ID NO: 656 - DNA, 22 bp, Artificial
  Synthetic oligonucleotide
gcagtgtgacgtttctggctgg

SEQ ID NO: 657 - DNA, 22 bp, Artificial
  Synthetic oligonucleotide
caatcggatgctggcccagcag

SEQ ID NO: 658 - DNA, 7 bp, Artificial
  Synthetic oligonucleotide
gcagtca

SEQ ID NO: 659 - DNA, 4 bp, Artificial
  Synthetic oligonucleotide
agag

SEQ ID NO: 660 - DNA, 5 bp, Artificial
  Synthetic oligonucleotide
aacag

SEQ ID NO: 661 - DNA, 14 bp, Artificial
  Synthetic oligonucleotide
cacattagttccag

SEQ ID NO: 662 - DNA, 40 bp, Artificial
  Synthetic oligonucleotide
aagaaagatggaaattctgaaaactgaatgtcaagaaaag

SEQ ID NO: 663 - protein, 631 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKRTAH

SEQ ID NO: 664 - protein, 501 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVVCA

SEQ ID NO: 665 - protein, 444 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQICHIWKLIFLP

SEQ ID NO: 666 - protein, 503 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVLMDQK

SEQ ID NO: 667 - protein, 628 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKR

SEQ ID NO: 668 - protein, 343 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNSQDLH

SEQ ID NO: 669 - protein, 563 aa, Homo sapiens [sequence omitted]

SEQ ID NO: 670 - protein, 459 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFAFGSGLVPMSPTSLLLLARLYFTWDMLLCWDSCMSTGLSSTCSRP

SEQ ID NO: 671 - protein, 397 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVEGQVRWLTPVIPALWEAKAGGSPEVRSSILAWPT

SEQ ID NO: 672 - protein, 329 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVG

SEQ ID NO: 673 - protein, 334 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAIGCWPSRQSREQHISSRRKMEILKTECQEKESRTIHSMRRKMEKKNFI

SEQ ID NO: 674 - protein, 160 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALMDPDWCQCLQLHFCS

SEQ ID NO: 675 - protein, 160 aa, Homo sapiens [sequence omitted]

SEQ ID NO: 676 - protein, 116 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCENSPGSADSIPPVPAG

SEQ ID NO: 677 - protein, 84 aa, Homo sapiens
MAPPGSSTVFLLALTIIASTWALTPTHYLTKHDVERLKASLDRPFTNLESAFYSIVGLSSLGAQVPDAKNSPGSADSIPPVPAG

SEQ ID NO: 678 - DNA, 1225 bp, Homo sapiens
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 679 - DNA, 1210 bp, Homo sapiens
tgtctctgagagcattgatgaggtcaggaagcctcctgttgggtagaggagcaactaagagactgaacttggcccccaccctgaggctcacaagcttgaattgcacctgagttccaaaggagaagttgacattcttccagaacatatgcccagtgtcttcaacttgagatggagctgggatgccaagtctgcaaatactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 680 - DNA, 1192 bp, Homo sapiens
cttggctggaggctctgcgaggacagctggggagaaggggagctgtgcccagatttaccaaagggaattgtcagctgtccaagggctagcaaattcctaggtcacctagattggattttctgaccataaaaactgtgggccaggtgcacagctgcctgaggggctcaaacctgtgcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 681 - DNA, 1177 bp, Homo sapiens
cttggctggaggctctgcgaggacagctggggagaaggggagctgtgatggaggctcgctctgttgccaggctggagtacagcgatctcggctcactgcaacctctgcctcccgggttcaagtgattctcctgcctcagcctcccaagtagctgggactacagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 682 - DNA, 1051 bp, Homo sapiens
gccttatttctctgctggttgagcgaagggattgtcttccatggtctccgagatcccgtcccacgctcatgccctagaattctctgagtccttgatgcacttttgcctttggcgaggaggcaggacagtcaggcgtggaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 683 - DNA, 1267 bp, Homo sapiens
tcctccccttctttccacacgcacaaccaccccaccccctgtggcctgagctgtcctgcctcgccacaatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaaggtataaaaacgcccttgggaccaggcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 684 - DNA, 211 bp, Artificial
  Synthetic oligonucleotide
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctgg

SEQ ID NO: 685 - DNA, 131 bp, Artificial
  Synthetic oligonucleotide
cccagatttaccaaagggaattgtcagctgtccaagggctagcaaattcctaggtcacctagattggattttctgaccataaaaactgtgggccaggtgcacagctgcctgaggggctcaaacctgtgcag

SEQ ID NO: 686 - DNA, 214 bp, Artificial
  Synthetic oligonucleotide
tcctccccttctttccacacgcacaaccaccccaccccctgtggcctgagctgtcctgcctcgccacaatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaag

SEQ ID NO: 687 - DNA, 140 bp, Artificial
  Synthetic oligonucleotide
gccttatttctctgctggttgagcgaagggattgtcttccatggtctccgagatcccgtcccacgctcatgccctagaattctctgagtccttgatgcacttttgcctttggcgaggaggcaggacagtcaggcgtggag

SEQ ID NO: 688 - DNA, 143 bp, Artificial
  Synthetic oligonucleotide
ctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggag

SEQ ID NO: 689 - DNA, 130 bp, Artificial
  Synthetic oligonucleotide
ccccacccatctgggccccgggttcaagagagagcggggtctgatctcgtgtagccatatagagtttgcttctgagtgtctgctttgtttagtagaggtgggcaggaggagctgaggggctggggctggg

SEQ ID NO: 690 - DNA, 140 bp, Artificial
  Synthetic oligonucleotide
ctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 691 - DNA, 93 bp, Artificial
  Synthetic oligonucleotide
tgtctctgagagcattgatgaggtcaggaagcctcctgttgggtagaggagcaactaagagactgaacttggcccccaccctgaggctcacaa

SEQ ID NO: 692 - DNA, 103 bp, Artificial
  Synthetic oligonucleotide
gcttgaattgcacctgagttccaaaggagaagttgacattcttccagaacatatgcccagtgtcttcaacttgagatggagctgggatgccaagtctgcaaat

SEQ ID NO: 693 - DNA, 47 bp, Artificial
  Synthetic oligonucleotide
cttggctggaggctctgcgaggacagctggggagaaggggagctgtg

SEQ ID NO: 694 - DNA, 18 bp, Artificial
  Synthetic oligonucleotide
atggaggctcgctctgtt

SEQ ID NO: 695 - DNA, 98 bp, Artificial
  Synthetic oligonucleotide
gccaggctggagtacagcgatctcggctcactgcaacctctgcctcccgggttcaagtgattctcctgcctcagcctcccaagtagctgggactacag

SEQ ID NO: 696 - DNA, 96 bp, Artificial
  Synthetic oligonucleotide
gtataaaaacgcccttgggaccaggcagcctcaaaccccagctgttggggccaggacacccagtgagcccatacttgctctttttgtcttcttcag

SEQ ID NO: 697 - DNA, 78 bp, Artificial
  Synthetic oligonucleotide
actgcgccatggggctcagcgacggggaatggcagttggtgctgaacgtctgggggaaggtggaggctgacatcccag

SEQ ID NO: 698 - DNA, 25 bp, Artificial
  Synthetic oligonucleotide
gccatgggcaggaagtcctcatcag

SEQ ID NO: 699 - DNA, 80 bp, Artificial
  Synthetic oligonucleotide
gctctttaagggtcacccagagactctggagaagtttgacaagttcaagcacctgaagtcagaggacgagatgaaggcgt

SEQ ID NO: 700 - DNA, 84 bp, Artificial
  Synthetic oligonucleotide
ttcatctcggaatgcatcatccaggttctgcagagcaagcatcccggggactttggtgctgatgcccagggggccatgaacaag

SEQ ID NO: 701 - DNA, 29 bp, Artificial
  Synthetic oligonucleotide
gccctggagctgttccggaaggacatggc

SEQ ID NO: 702 - DNA, 28 bp, Artificial
  Synthetic oligonucleotide
ctccaactacaaggagctgggcttccag

SEQ ID NO: 703 - DNA, 23 bp, Artificial
  Synthetic oligonucleotide
ggctaggcccctgccgctcccac

SEQ ID NO: 704 - DNA, 13 bp, Artificial
  Synthetic oligonucleotide
gtgttgaagttgg

SEQ ID NO: 705 - DNA, 22 bp, Artificial
  Synthetic oligonucleotide
ctttgcatgcccagcgatgcgc

SEQ ID NO: 706 - DNA, 45 bp, Artificial
  Synthetic oligonucleotide
ctccctgtgggatgtcatcaccctgggaaccgggagtggcccttg

SEQ ID NO: 707 - DNA, 56 bp, Artificial
  Synthetic oligonucleotide
gctcactgtgttctgcatggtttggatctgaattaattgtcctttcttctaaatcc

SEQ ID NO: 708 - DNA, 118 bp, Artificial
  Synthetic oligonucleotide
caaccgaacttcttccaacctccaaactggctgtaaccccaaatccaagccattaactacacctgacagtagcaattgtctgattaatcactggccccttgaagacagcagaatgtcc

SEQ ID NO: 709 - protein, 153 aa, Homo sapiens
GLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 710 - protein, 154 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 711 - protein, 99 aa, Homo sapiens
MKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 712 - protein, 154 aa, Homo sapiens; identical to SEQ ID NO: 710

SEQ ID NO: 713 - protein, 99 aa, Homo sapiens; identical to SEQ ID NO: 711

SEQ ID NO: 714 - protein, 135 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKG

SEQ ID NO: 715 - protein, 154 aa, Homo sapiens; identical to SEQ ID NO: 710

SEQ ID NO: 716 - DNA, 2715 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatggtgagtgagcccacatatagatgaccccagacattagggaacaggccccagcctaatttgtaatcccctagagtctgagggtgtcttcaccaccacagtgactgggagaggatgaggaggaacgtctaaggttgcaggggcctctgtaggatccccaatcctccttcttagtccctggaaggatgtttctccacctttctttgctgataccctcctctcttcactgttccactcccttgcttcctctggctgccagcagacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 717 - DNA, 2931 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaaggtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcagacttgggggtagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 718 - DNA, 3190 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatggtgagtgagcccacatatagatgaccccagacattagggaacaggccccagcctaatttgtaatcccctagagtctgagggtgtcttcaccaccacagtgactgggagaggatgaggaggaacgtctaaggttgcaggggcctctgtaggatccccaatcctccttcttagtccctggaaggatgtttctccacctttctttgctgataccctcctctcttcactgttccactcccttgcttcctctggctgccagcagacacccccatgacccttccaaaaggtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcagacttgggggtagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 719 - DNA, 2385 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 720 - DNA, 2577 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggtaagaggaggaacagccgggtacctaggggaagagaccagaggtcagcggccaggctgtgattcccaaagccacacaggaccctcaaagaagccctctgccccatctcctctccctgcaggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 721 - DNA, 2297 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 722 - DNA, 2457 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccgtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaattcagtccagattcaagggaaggaacctatatgcataccggaaagtgtgacctattgcagcccccacatctattgtgtctttctcctggatatctcacacataaccctgattctcctagtatttaagaaagctatcatcttgaggcgcggtggctcacgcctataatcccagcactttaggaggccgaggcgggtggatcacttgaggtcaggagttcgagaccagcctggccaacatggtgaaaccccgtctttactaaaaatacaaaaatcagccgggcatgatgtcgcttgcctgtaatcccagctacttaggaggctgaggcaagagaattgcttgaacccgggaggtggaggttgcagtgagctgagatcgcatcattgcactccagctgggcaacaagagtgagactctgtctc

SEQ ID NO: 723 - DNA, 4104 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgctcacatccttccagctcccaaatgcgccgctattcctcagacgcccgcgcctcaggctcttctcttgtcccttagaccctctttctgtctcttggaccccttcctatcccctgaacaccgcttctctgccccttcccagtctctcagctcagcttcctgaccctgaaacatggaccctcacatgctgtgtctttgacccctgcttcttggcccttggattcctactccccccgccgtcgatcctatgttctgtcccttggattttcactgcctttcccagaatcgtcttttttttttttttttttttgagacaggttcttgctctgtcgcccaggcaggagagcagtgtgcgatcttggctcattgcaacttccacctcctgggttcaagcaattctcctgcctcagcctctcgagtagctgggattacaggagcctgccaccacactgggctaatttttttttttttttttgacagagtctcgctctgtttcccaggctggagtgcagtgacatgatctgggctcactgcaacctccgcctactgggttcaagctattctcctgcctcagcctcctgagtagctgggactacaggcgggtgtcaccacatctggctgatttttgtatttttagtagagacagggtttcaccatactggtcaggctggtcttgaactcgacctcaggtgatccacccttggcctcctaaagtactcggattacaggtgtgagccaccacgcccggccccagctaatttttgtatttttggtagacacgggtttcagcatgttggccaggctggtcttgaactcctgacctcaggtgatctgcctgccttggcctcccaaagtgctgggattacaggcgtgagccaccatgcccagccagaaaccccaataacttttgcaccaatctaatatttttagcagagacagggttttgccatgttgcccaggctggtctcgaactcctgacctcaggtgatctgcccacctcggcctcccaaagtgctgggattacaggcgtgagccaccatgcccggccagaaaccccaataacttgcaccaatctaatatttttagcagagacagggttttgccatgttgcccaggctagtctcaaactcctgacctcaggtgatctgcctacctcggcctcccaaagtgctgggattacaggcatgagccaccgcgcccggtcgagaatctccttcttgttccttgaaccctcttcctgtccctcaacctcctttctccataacttcacttgttttccctggaacccctgttctgtgcgctcaaatttgaattcccctttcctggatgttttcttcctgtctatgaaactccattctgtgctcttgaactccaaatcttgccttgaaccatgtcatttctatatgaccctccaatcctcaatctctgtctctggaatcccctcaaaccccactttctgttccttggactttattcttcaatttccttctcctatggcccagttcctaacccttgtaccacacatcctgtccattgcatgtgccgcttttcctcagtcgctattgaattcctccttcatactgcttcagtttcctcatctccagcctgcattgcgcagttcatccttcatgtccactcacccacaggtgcatacccaccttcaagtgattgaggagagggtgaatcagagcctgggcctgcttgaccagaacccccacctggctcaggagctgcggccccaaatccgtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaattcagtccagattcaagggaaggaacctatatgcataccggaaagtgtgacctattgcagcccccacatctattgtgtctttctcctggatatctcacacataaccctgattctcctagtatttaagaaagctatcatcttgaggcgcggtggctcacgcctataatcccagcactttaggaggccgaggcgggtggatcacttgaggtcaggagttcgagaccagcctggccaacatggtgaaaccccgtctttactaaaaatacaaaaatcagccgggcatgatgtcgcttgcctgtaatcccagctacttaggaggctgaggcaagagaattgcttgaacccgggaggtggaggttgcagtgagctgagatcgcatcattgcactccagctgggcaacaagagtgagactctgtctc

SEQ ID NO: 724 - DNA, 1795 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 725 - DNA, 160 bp, Artificial
  Synthetic oligonucleotide
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccg

SEQ ID NO: 726 - DNA, 133 bp, Artificial
  Synthetic oligonucleotide
atgtacccggagctgcagattgcacgtgtggagcaggctacgcaggccatccccatggagcgctggtgcgggggttcccggagcggcagctgcgcccacccccaccaccaggttgtgcccttccgctgcctgc

SEQ ID NO: 727 - DNA, 134 bp, Artificial
  Synthetic oligonucleotide
gcctgcagctcccagggcctcatcctgcacggctcgggcatgctcttaccctgtggctcggatcggttccgtggtgtggagtatgtgtgctgtccccctccagggacccccgacccatctgggacagcagttgg

SEQ ID NO: 728 - DNA, 179 bp, Artificial
  Synthetic oligonucleotide
tgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaag

SEQ ID NO: 729 - DNA, 131 bp, Artificial
  Synthetic oligonucleotide
tcactcccaccccgaggcccacagacggtgtggatatttactttggcatgcctggggaaatcagtgagcacgaggggttcctgagggccaagatggacctggaggagcgtaggatgcgccagattaatgag

SEQ ID NO: 730 - DNA, 159 bp, Artificial
  Synthetic oligonucleotide
cacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcag

SEQ ID NO: 731 - DNA, 129 bp, Artificial
  Synthetic oligonucleotide
gcggagcgtgtcctgttggccctgcggcgctacctgcgtgcggagcagaaggaacagaggcacacgctgcgccactaccagcatgtggccgccgtggatcccgagaaggcacagcagatgcgcttccag

SEQ ID NO: 732 - DNA, 1643 bp, Artificial
  Synthetic oligonucleotide
tcacatccttccagctcccaaatgcgccgctattcctcagacgcccgcgcctcaggctcttctcttgtcccttagaccctctttctgtctcttggaccccttcctatcccctgaacaccgcttctctgccccttcccagtctctcagctcagcttcctgaccctgaaacatggaccctcacatgctgtgtctttgacccctgcttcttggcccttggattcctactccccccgccgtcgatcctatgttctgtcccttggattttcactgcctttcccagaatcgtcttttttttttttttttttttgagacaggttcttgctctgtcgcccaggcaggagagcagtgtgcgatcttggctcattgcaacttccacctcctgggttcaagcaattctcctgcctcagcctctcgagtagctgggattacaggagcctgccaccacactgggctaatttttttttttttttttgacagagtctcgctctgtttcccaggctggagtgcagtgacatgatctgggctcactgcaacctccgcctactgggttcaagctattctcctgcctcagcctcctgagtagctgggactacaggcgggtgtcaccacatctggctgatttttgtatttttagtagagacagggtttcaccatactggtcaggctggtcttgaactcgacctcaggtgatccacccttggcctcctaaagtactcggattacaggtgtgagccaccacgcccggccccagctaatttttgtatttttggtagacacgggtttcagcatgttggccaggctggtcttgaactcctgacctcaggtgatctgcctgccttggcctcccaaagtgctgggattacaggcgtgagccaccatgcccagccagaaaccccaataacttttgcaccaatctaatatttttagcagagacagggttttgccatgttgcccaggctggtctcgaactcctgacctcaggtgatctgcccacctcggcctcccaaagtgctgggattacaggcgtgagccaccatgcccggccagaaaccccaataacttgcaccaatctaatatttttagcagagacagggttttgccatgttgcccaggctagtctcaaactcctgacctcaggtgatctgcctacctcggcctcccaaagtgctgggattacaggcatgagccaccgcgcccggtcgagaatctccttcttgttccttgaaccctcttcctgtccctcaacctcctttctccataacttcacttgttttccctggaacccctgttctgtgcgctcaaatttgaattcccctttcctggatgttttcttcctgtctatgaaactccattctgtgctcttgaactccaaatcttgccttgaaccatgtcatttctatatgaccctccaatcctcaatctctgtctctggaatcccctcaaaccccactttctgttccttggactttattcttcaatttccttctcctatggcccagttcctaacccttgtaccacacatcctgtccattgcatgtgccgcttttcctcagtcgctattgaattcctccttcatactgcttcagtttcctcatctccagcctgcattgcgcagttcatccttcatgtccactcacccacag

SEQ ID NO: 733 - DNA, 872 bp, Artificial
  Synthetic oligonucleotide
gtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaattcagtccagattcaagggaaggaacctatatgcataccggaaagtgtgacctattgcagcccccacatctattgtgtctttctcctggatatctcacacataaccctgattctcctagtatttaagaaagctatcatcttgaggcgcggtggctcacgcctataatcccagcactttaggaggccgaggcgggtggatcacttgaggtcaggagttcgagaccagcctggccaacatggtgaaaccccgtctttactaaaaatacaaaaatcagccgggcatgatgtcgcttgcctgtaatcccagctacttaggaggctgaggcaagagaattgcttgaacccgggaggtggaggttgcagtgagctgagatcgcatcattgcactccagctgggcaacaagagtgagactctgtctc

SEQ ID NO: 734 - DNA, 259 bp, Artificial
  Synthetic oligonucleotide
gtgagtgagcccacatatagatgaccccagacattagggaacaggccccagcctaatttgtaatcccctagagtctgagggtgtcttcaccaccacagtgactgggagaggatgaggaggaacgtctaaggttgcaggggcctctgtaggatccccaatcctccttcttagtccctggaaggatgtttctccacctttctttgctgataccctcctctcttcactgttccactcccttgcttcctctggctgccagcag

SEQ ID NO: 735 - DNA, 463 bp, Artificial
  Synthetic oligonucleotide
gtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcag

SEQ ID NO: 736 - DNA, 121 bp, Artificial
  Synthetic oligonucleotide
gtaagaggaggaacagccgggtacctaggggaagagaccagaggtcagcggccaggctgtgattcccaaagccacacaggaccctcaaagaagccctctgccccatctcctctccctgcag

SEQ ID NO: 737 - DNA, 144 bp, Artificial
  Synthetic oligonucleotide
gcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggag

SEQ ID NO: 738 - DNA, 304 bp, Artificial
  Synthetic oligonucleotide
aaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 739 - DNA, 44 bp, Artificial
  Synthetic oligonucleotide
ctgctcgcggtctaagtcgccgcccgggccagccgccgctgccg

SEQ ID NO: 740 - DNA, 20 bp, Artificial
  Synthetic oligonucleotide
ctgctgctgccactattgct

SEQ ID NO: 741 - DNA, 64 bp, Artificial
  Synthetic oligonucleotide
gctgcttctgcgcgcgcagcccgccatcgggagcctggccggtgggagccccggcgcggccgag

SEQ ID NO: 742 - DNA, 82 bp, Artificial
  Synthetic oligonucleotide
gccccggggtcggcccaggtggctggactatgcgggcgcctaacccttcaccgggacctgcgcaccggccgctgggaaccag

SEQ ID NO: 743 - DNA, 62 bp, Artificial
  Synthetic oligonucleotide
acccacagcgctctcgacgctgtctccgggacccgcagcgcgtgctggagtactgcagacag

SEQ ID NO: 744 - DNA, 113 bp, Artificial
  Synthetic oligonucleotide
ctggtgaatttgtgagtgaggccctgctggtgcctgaaggctgccggttcttgcaccaggagcgcatggaccaatgtgagagttcaacccggaggcatcaggaggcacaggag

SEQ ID NO: 745 - DNA, 75 bp, Artificial
  Synthetic oligonucleotide
gtgatgcgtgaatgggccatggcagacaaccagtccaagaacctgcctaaagccgacagacaggccctgaatgag

SEQ ID NO: 746 - DNA, 4 bp, Artificial
  Synthetic oligonucleotide
gtgc

SEQ ID NO: 747 - DNA, 72 bp, Artificial
  Synthetic oligonucleotide
gtgcatacccaccttcaagtgattgaggagagggtgaatcagagcctgggcctgcttgaccagaacccccac

SEQ ID NO: 748 - DNA, 28 bp, Artificial
  Synthetic oligonucleotide
ctggctcaggagctgcggccccaaatcc

SEQ ID NO: 749 - DNA, 108 bp, Artificial
  Synthetic oligonucleotide
aggaactcctccactctgaacacctgggtcccagtgaattggaagcccctgcccctgggggcagcagcgaggacaagggtgggctgcagcctccagattccaaggatg

SEQ ID NO: 750 - DNA, 24 bp, Artificial
  Synthetic oligonucleotide
acacccccatgacccttccaaaag

SEQ ID NO: 751 - DNA, 12 bp, Artificial
  Synthetic oligonucleotide
acttgggggtag

SEQ ID NO: 752 - DNA, 9 bp, Artificial
  Synthetic oligonucleotide
ggtccacag

SEQ ID NO: 753 - DNA, 62 bp, Artificial
  Synthetic oligonucleotide
aacaagatgctgcatcccctgagaaagagaagatgaacccgctggaacagtatgagcgaaag

SEQ ID NO: 754 - DNA, 63 bp, Artificial
  Synthetic oligonucleotide
gtgaatgcgtctgttccaaggggtttccctttccactcatcggagattcagagggatgagctg

SEQ ID NO: 755 - DNA, 36 bp, Artificial
  Synthetic oligonucleotide
gtggaccccatgctgaccctggaggagcagcagctc

SEQ ID NO: 756 - DNA, 39 bp, Artificial
  Synthetic oligonucleotide
cgcgaactgcagcggcacggctatgagaaccccacttac

SEQ ID NO: 757 - DNA, 59 bp, Artificial
  Synthetic oligonucleotide
cgcttcctggaggaacgaccctgacccggcccccttcaccccttcagccgagcccagac

SEQ ID NO: 758 - DNA, 17 bp, Artificial
  Synthetic oligonucleotide
ctcccctcttcctggag

SEQ ID NO: 759 - DNA, 6 bp, Artificial
  Synthetic oligonucleotide
ccccag

SEQ ID NO: 760 - protein, 650 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 761 - protein, 519 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDGE

SEQ ID NO: 762 - protein, 541 aa, Homo sapiens [sequence omitted]

SEQ ID NO: 763 - protein, 544 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGECVCSKGFPFPLIGDSEG

SEQ ID NO: 764 - protein, 619 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELVRGGTAGYLGEETRGQRPGCDSQSHTGPSKKPSAPSPLPAGTSWDRGVP

SEQ ID NO: 765 - protein, 597 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 766 - protein, 498 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIRECLLPWLPLQISEGRS

SEQ ID NO: 767 - protein, 588 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVLTSFQLPNAPLFLRRPRLRLFSCPLDPLSVSWTPSYPLNTASLPLPSLSAQLPDPETWTLTCCVFDPCFLALGFLLPPPSILCSVPWIFTAFPRIVFFFFFFLRQVLALSPRQESSVRSWLIATSTSWVQAILLPQPLE

SEQ ID NO: 768 - protein, 505 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQPQNPNSQPRAAGSLEVIISHPFVRRLEILISPFQFQNSIPKNSQIVPAASPRGTSSP

SEQ ID NO: 769 - DNA, 1749 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacgatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 770 - DNA, 1436 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtttttgcagatttataaacaagggggttttctgggcctctccaatattaagttcagtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 771 - DNA, 1455 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcagtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 772 - DNA, 1407 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 773 - DNA, 1380 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 774 - DNA, 1330 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 775 - DNA, 1423 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 776 - DNA, 1325 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgcttctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 777 - DNA, 1404 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtttttgcagatttataaacaagggggttttctgggcctctccaatattaagttcagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 778 - DNA, 1298 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 779 - DNA, 1304 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 780 - DNA, 1314 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtttttgcagatttataaacaagggggttttctgggcctctccaatattaagttcaggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 781 - DNA, 1235 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 782 - DNA, 1582 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtagaagaagaagtgtcagcagaccaggtgagcgtgggtgccagtggggttcttgggagcttcaaggaagcaaggaacgctccctccttcctctcctggtctttctctatgggacctagtaaataattactgcagccacctgaggctggaaaaccactccaggtgggggaggagagagtttagttttcttgctcctattttcctcctcctggagacctccctctctcggctttacaaagacacagatacaccccgccccccaaaacacacacacacacacacacacacacacctccttaggctggaacagcagagaatggagggacaagggggctgattagagccaagaagagggagtgaaggagagcagagggaggagggcagccctgtttacagtcacctggctggtggggtggcaggtgctctctctgaattaaccctttgagagctggccaggactctggactgattaccccagcctggggtggcatccaggggctctaggaggtaccttttgctcctcaccctggatctcttttccttccacccaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 783 - DNA, 564 bp, Artificial
  Synthetic oligonucleotide
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacag

SEQ ID NO: 784 - DNA, 176 bp, Artificial
  Synthetic oligonucleotide
gctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacg

SEQ ID NO: 785 - DNA, 132 bp, Artificial
  Synthetic oligonucleotide
gatctgtggtggtacaattgactctggccttccgagaaggtaccatcaatgtccacgacgtggagacacagttcaatcagtataaaacggaagcagcctctcgatataacctgacgatctcagacgtcagcg

SEQ ID NO: 786 - DNA, 140 bp, Artificial
  Synthetic oligonucleotide
gctgtctgtcagtgccgccgaaagaactacgggcagctggacatctttccagcccgggatacctaccatcctatgagcgagtaccccacctaccacacccatgggcgctatgtgccccctagcagtaccgatcgtagccc

SEQ ID NO: 787 - DNA, 524 bp, Artificial
  Synthetic oligonucleotide
gtgagcgtgggtgccagtggggttcttgggagcttcaaggaagcaaggaacgctccctccttcctctcctggtctttctctatgggacctagtaaataattactgcagccacctgaggctggaaaaccactccaggtgggggaggagagagtttagttttcttgctcctattttcctcctcctggagacctccctctctcggctttacaaagacacagatacaccccgccccccaaaacacacacacacacacacacacacacacctccttaggctggaacagcagagaatggagggacaagggggctgattagagccaagaagagggagtgaaggagagcagagggaggagggcagccctgtttacagtcacctggctggtggggtggcaggtgctctctctgaattaaccctttgagagctggccaggactctggactgattaccccagcctggggtggcatccaggggctctaggaggtaccttttgctcctcaccctggatctcttttccttccacccag

SEQ ID NO: 788 - DNA, 262 bp, Artificial
  Synthetic oligonucleotide
ttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 789 - DNA, 27 bp, Artificial
  Synthetic oligonucleotide
ctaccacagcccctaaacccgcaacag

SEQ ID NO: 790 - DNA, 9 bp, Artificial
  Synthetic oligonucleotide
ttgttacag

SEQ ID NO: 791 - DNA, 27 bp, Artificial
  Synthetic oligonucleotide
gttctggtcatgcaagctctaccccag

SEQ ID NO: 792 - DNA, 38 bp, Artificial
  Synthetic oligonucleotide
gtggagaaaaggagacttcggctacccagagaagttca

SEQ ID NO: 793 - DNA, 27 bp, Artificial
  Synthetic oligonucleotide
gtgcccagctctactgagaagaatgct

SEQ ID NO: 794 - DNA, 19 bp, Artificial
  Synthetic oligonucleotide
tttaattcctctctggaag

SEQ ID NO: 795 - DNA, 50 bp, Artificial
  Synthetic oligonucleotide
atcccagcaccgactactaccaagagctgcagagagacatttctgaaatg

SEQ ID NO: 796 - DNA, 9 bp, Artificial
  Synthetic oligonucleotide
tttttgcag

SEQ ID NO: 797 - DNA, 47 bp, Artificial
  Synthetic oligonucleotide
atttataaacaagggggttttctgggcctctccaatattaagttcag

SEQ ID NO: 798 - DNA, 5 bp, Artificial
  Synthetic oligonucleotide
gccag

SEQ ID NO: 799 - DNA, 32 bp, Artificial
  Synthetic oligonucleotide
tgagtgatgtgccatttcctttctctgcccag

SEQ ID NO: 800 - DNA, 90 bp, Artificial
  Synthetic oligonucleotide
tctggggctggggtgccaggctggggcatcgcgctgctggtgctggtctgtgttctggttgcgctggccattgtctatctcattgccttg

SEQ ID NO: 801 - DNA, 10 bp, Artificial
  Synthetic oligonucleotide
ctatgagaag

SEQ ID NO: 802 - DNA, 27 bp, Artificial
  Synthetic oligonucleotide
gtagaagaagaagtgtcagcagaccag

SEQ ID NO: 803 - DNA, 32 bp, Artificial
  Synthetic oligonucleotide
gtttctgcaggtaatggtggcagcagcctctc

SEQ ID NO: 804 - DNA, 99 bp, Artificial
  Synthetic oligonucleotide
ttacacaaacccagcagtggcagccacttctgccaacttgtaggggcacgtcgcccgctgagctgagtggccagccagtgccattccactccactcagg

SEQ ID NO: 805 - protein, 1255 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 806 - protein, 203 aa, Homo sapiens
MTPGTQSPFFLLLLLTVLTVVTGSGHASSTPGGEKETSATQRSSVPSSTEKNAIPAPTTTKSCRETFLKCFCRFINKGVFWASPILSSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 807 - protein, 149 aa, Homo sapiens
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFSLGLGCQAGASRCWCWSVFWLRWPLSISLPWLSVSAAERTTGSWTSFQPGIPTIL

SEQ ID NO: 808 - protein, 166 aa, Homo sapiens
MTPGTQSPFFLLLLLTVLTATTAPKPATVVTGSGHASSTPGGEKETSATQRSSVPSSTEKNASGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 809 - protein, 157 aa, Homo sapiens
MTPGTQSPFFLLLLLTVLTVVTGSGHASSTPGGEKETSATQRSSVPSSTEKNASGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 810 - protein, 159 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 811 - protein, 136 aa, Homo sapiens
MTPGTQSPFFLLLLLTVLTATTAPKPATVVTGSGHASSTPGGEKETSATQRSSVPSSTEKNAAVCQCRRKNYGQLDIFPARDTYHPMSEYPTYHTHGRYVPPSSTDRSPYEKVSAGNGGSSLSYTNPAVAATSANL

SEQ ID NO: 812 - protein, 80 aa, Homo sapiens
MTPGTQSPFFLLLLLTVLTATTAPKPATVATGSGHASSTPGGEKETSATQRSSVPSSTEKNAIPAPTTTKSCRETFLKCE

SEQ ID NO: 813 - protein, 126 aa, Homo sapiens [sequence omitted]

SEQ ID NO: 814 - protein, 71 aa, Homo sapiens [sequence omitted]

SEQ ID NO: 815 - protein, 53 aa, Homo sapiens
MTPGTQSPFFLLLLLTVLTVVTGSGHASSTPGGEKETSATQRSSVPSSTEKNA

SEQ ID NO: 816 - protein, 128 aa, Homo sapiens [sequence omitted]

SEQ ID NO: 817 - protein, 158 aa, Homo sapiens [sequence omitted]

SEQ ID NO: 818 - protein, 96 aa, Homo sapiens [sequence omitted]

SEQ ID NO: 819 - protein, 85 aa, Homo sapiens
MTPGTQSPFFLLLLLTVLTVVTGSGHASSTPGGEKETSATQRSSVEEEVSADQVSVGASGVLGSFKEARNAPSFLSWSFSMGPSK

SEQ ID NO: 820 - DNA, 516 bp, Homo sapiens
gtgctcacctccacagcggcttccttgatccttgccacccgcgactgaacaccgacagcagcagcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgagcaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaaaaaaaaaat

SEQ ID NO: 821 - DNA, 907 bp, Homo sapiens
gtgctcacctccacagcggcttccttgatccttgccacccgcgactgaacaccgacagcagcagcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgaggtgtttatggtaatttcattttcttcctataagctttttaaatcccctgaccagggacaagtgggctcttcatttctcactgacaatgccaaagccactagtgaacaagccttttcttacattggttaatttagttgaatggttagtctaatgactttgccatcaagaaaaacatccagtgtccctgtgttgtcactctacccagagaatcctcagtggatgataaatgaatagggcaagagaggaaaaggaaaggtcggtagaagtcttacctatccccagagctctctaattcatgctcacaaacacagacacaatcacacaaacacagaaacacacatacacacatccagacacatgcaaacacacagacacagtcacaatcacacaaacacacacacattcagacatacacaaacatagacagacaggcaaagacacagacacagacacagacacaatcacaccagcacacaatcatccagacacaaacacaaacacacagacagaaccacacaaccacagaaacacagagacacacacaaacacactcagacacacacatacaaacatatgttcactctctacagaaaaaacaattt

SEQ ID NO: 822 - DNA, 126 bp, Artificial
  Synthetic oligonucleotide
gtgctcacctccacagcggcttccttgatccttgccacccgcgactgaacaccgacagcagcagcctcaccatgaagttgctgatggtcctcatgctggcggccctctcccagcactgctacgcag

SEQ ID NO: 823 - DNA, 179 bp, Artificial
  Synthetic oligonucleotide
gctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgag

SEQ ID NO: 824 - DNA, 593 bp, Artificial
  Synthetic oligonucleotide
gtaatttcattttcttcctataagctttttaaatcccctgaccagggacaagtgggctcttcatttctcactgacaatgccaaagccactagtgaacaagccttttcttacattggttaatttagttgaatggttagtctaatgactttgccatcaagaaaaacatccagtgtccctgtgttgtcactctacccagagaatcctcagtggatgataaatgaatagggcaagagaggaaaaggaaaggtcggtagaagtcttacctatccccagagctctctaattcatgctcacaaacacagacacaatcacacaaacacagaaacacacatacacacatccagacacatgcaaacacacagacacagtcacaatcacacaaacacacacacattcagacatacacaaacatagacagacaggcaaagacacagacacagacacagacacaatcacaccagcacacaatcatccagacacaaacacaaacacacagacagaaccacacaaccacagaaacacagagacacacacaaacacactcagacacacacatacaaacatatgttcactctctacagaaaaaacaattt

SEQ ID NO: 825 - DNA, 211 bp, Artificial
  Synthetic oligonucleotide
caattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaaaaaaaaaat

SEQ ID NO: 826 - DNA, 9 bp, Artificial
  Synthetic oligonucleotide
gtgtttatg

SEQ ID NO: 827 - protein, 93 aa, Homo sapiens
MKLLMVLMLAALSQHCYAGSGCPLLENVISKTINPQVSKTEYKELLQEFIDDNATTNAIDELKECFLNQTDETLSNVEVFMQLIYDSSLCDLF

SEQ ID NO: 828 - protein, 90 aa, Homo sapiens
MKLLMVLMLAALSQHCYAGSGCPLLENVISKTINPQVSKTEYKELLQEFIDDNATTNAIDELKECFLNQTDETLSNVEQLIYDSSLCDLF

SEQ ID NO: 829 - protein, 344 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDGPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 830 - DNA, 21 bp, Homo sapiens
ccagcaatccacacaagagct

SEQ ID NO: 831 - DNA, 21 bp, Homo sapiens
cagggtctggtccaatcagag

SEQ ID NO: 832 - DNA, 144 bp, Homo sapiens
ccagcaatccacacaagagctctttatccccaacatcactgtgaataatagcggatcctatatgtgccaagcccataactcagccactggcctcaataggaccacagtcacgatgatcacagtctctgattggaccagaccctg

SEQ ID NO: 833 - protein, 478 aa, Homo sapiens; identical to SEQ ID NO: 50

SEQ ID NO: 834 - DNA, 20 bp, Homo sapiens
ggggcagaacctctgacaag

SEQ ID NO: 835 - DNA, 17 bp, Homo sapiens
gggcagcccagccagta

SEQ ID NO: 836 - DNA, 109 bp, Artificial
  Synthetic oligonucleotide
ggggcagaacctctgacaagtactaccgagtcaatcttcgcacacggcgagtggacactgtggaccctccctacccacgctccatcgctcagtactggctgggctgccc

SEQ ID NO: 837 - DNA, 24 bp, Artificial
  Synthetic oligonucleotide
gcagtcttggattcctttcacatt

SEQ ID NO: 838 - DNA, 24 bp, Artificial
  Synthetic oligonucleotide
gaggctgttgaagttaggatctcc

SEQ ID NO: 839 - DNA, 101 bp, Artificial
  Synthetic oligonucleotide
gcagtcttggattcctttcacatttcactggggacaggcctcagcatgtgcccacccctgacccccacctcatgctgggagatcctaacttcaacagcctc

SEQ ID NO: 840 - protein, 871 aa, Homo sapiens [sequence omitted]

SEQ ID NO: 841 - protein, 40 aa, Homo sapiens
LRSCQGYKQCNPRPKNLDVGNKDGGSYDLHRGQLWDGWEG

SEQ ID NO: 842 - DNA, 23 bp, Homo sapiens
gttgcatttctcagtgctggttt

SEQ ID NO: 843 - DNA, 16 bp, Homo sapiens
agggtgccgggtgagg

SEQ ID NO: 844 - DNA, 106 bp, Homo sapiens
gttgcatttctcagtgctggtttctaatcagaccagtggattgagtttctctaccatcctccccacgttcttctctaagctgcctccaagcctcacccggcaccct

SEQ ID NO: 845 - DNA, 20 bp, Homo sapiens
ggacggatacagcaggaacg

SEQ ID NO: 846 - DNA, 23 bp, Homo sapiens
tattttccaaaaaaggccagctc

SEQ ID NO: 847 - DNA, 95 bp, Homo sapiens
ggacggatacagcaggaacgaaaaaacatccgacccaacattattcttgtgcttaccgatgatcaagatgtggagctggccttttttggaaaata

SEQ ID NO: 848 - protein, 250 aa, Homo sapiens [sequence omitted]

SEQ ID NO: 849 - protein, 148 aa, Homo sapiens
MEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGVRIFLALSLTLIVPWSQGWTRQRDQR

SEQ ID NO: 850 - protein, 250 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 851 - protein, 250 aa, Homo sapiens [sequence omitted]

SEQ ID NO: 852 - DNA, 24 bp, Artificial
  Synthetic oligonucleotide
ccaccagttaactacaagtgcctg

SEQ ID NO: 853 - DNA, 18 bp, Artificial
  Synthetic oligonucleotide
gcgtgcatgagctgcatg

SEQ ID NO: 854 - DNA, 104 bp, Artificial
  Synthetic oligonucleotide
ccaccagttaactacaagtgcctgcagctctacgccccagggctgtcgccagacactatcatggagtgtgcaatgggggaccgcggcatgcagctcatgcacgc

SEQ ID NO: 855 - DNA, 18 bp, Homo sapiens
accagccacctcaaccca

SEQ ID NO: 856 - DNA, 22 bp, Homo sapiens
ctggagcagagagtctttgcct

SEQ ID NO: 857 - DNA, 110 bp, Homo sapiens
accagccacctcaacccaaggccctgggcaatcagcagccttcgtgggattcagaggatagcagcaacttcaaagatgtaggttcaaaaggcaaagactctctgctccag

SEQ ID NO: 858 - protein, 166 aa, Homo sapiens
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPLLIENMKKALRLIQSEL

SEQ ID NO: 859 - DNA, 30 bp, Artificial
  Synthetic oligonucleotide
tacaaaattagtagaaatcagcattcttgc

SEQ ID NO: 860 - DNA, 32 bp, Artificial
  Synthetic oligonucleotide
tgtagaactaacaagagctgatattattggat

SEQ ID NO: 861 - DNA, 118 bp, Artificial
  Synthetic oligonucleotide
tacaaaattagtagaaatcagcattcttgcttttatttttaaatgctagttcaagtactattctttttaaagagaagtcatttctaatccaataatatcagctcttgttagttctaca

SEQ ID NO: 862 - protein, 111 aa, Homo sapiens [sequence omitted]

SEQ ID NO: 863 - protein, 111 aa, Homo sapiens
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 864 - DNA, 21 bp, Artificial
  Synthetic oligonucleotide
ggcgtctttctccctctgaac

SEQ ID NO: 865 - DNA, 20 bp, Artificial
  Synthetic oligonucleotide
gtcccattctgggtgctgtg

SEQ ID NO: 866 - DNA, 114 bp, Artificial
  Synthetic oligonucleotide
ggcgtctttctccctctgaacctcagtttccacctgtgtcgagtgtgggtgagacccctcgcggggagctatgcaggttacggagaaaaggcagcacagcacccagaatgggac

SEQ ID NO: 867 - DNA, 22 bp, Artificial
  Synthetic oligonucleotide
atttccatcctcaactggcaga

SEQ ID NO: 868 - DNA, 16 bp, Artificial
  Synthetic oligonucleotide
tgccctggaacccacg

SEQ ID NO: 869 - DNA, 104 bp, Artificial
  Synthetic oligonucleotide
atttccatcctcaactggcagagatgagagcctggagcattgcagatgccagggacttcacaaatgaaggcacagcatgggaaacctgcgtgggttccagggca

SEQ ID NO: 870 - DNA, 20 bp, Artificial
  Synthetic oligonucleotide
tctgctggccactgtgactg

SEQ ID NO: 871 - DNA, 21 bp, Artificial
  Synthetic oligonucleotide
gaagaaaaagagctcgcctcg

SEQ ID NO: 872 - DNA, 136 bp, Artificial
  Synthetic oligonucleotide
tctgctggccactgtgactgcagcatatgccctcagcatgtgtccctctctcccaccccagccagacgccccgccagatgcctgtgaggcctcctttgacgcggtctccaccatccgaggcgagctctttttcttc

SEQ ID NO: 873 - DNA, 25 bp, Artificial
  Synthetic oligonucleotide
acatttggttcttccaagggactac

SEQ ID NO: 874 - DNA, 19 bp, Artificial
  Synthetic oligonucleotide
tcgatctcagagggcaccc

SEQ ID NO: 875 - DNA, 100 bp, Artificial
  Synthetic oligonucleotide
acatttggttcttccaagggactactggcgtttccaccccagcacccggcgtgtagacagtcccgtgccccgcagggccactgactggagaggggtgccc

SEQ ID NO: 876 - DNA, 19 bp, Artificial
  Synthetic oligonucleotide
cactgccccagcttatccc

SEQ ID NO: 877 - DNA, 21 bp, Artificial
  Synthetic oligonucleotide
ctctcccagcctcagtttcct

SEQ ID NO: 878 - DNA, 108 bp, Artificial
  Synthetic oligonucleotide
cactgccccagcttatcccaggcctcccgcttccctctgcgggtggggtgctgagcaggcattattggcctgcatgttttactgatgaggaaactgaggctgggagag

SEQ ID NO: 879 - DNA, 20 bp, Artificial
  Synthetic oligonucleotide
tgatgatgaagcccctgatg

SEQ ID NO: 880 - DNA, 22 bp, Artificial
  Synthetic oligonucleotide
tattgtcaaggggctggaatgt

SEQ ID NO: 881 - DNA, 126 bp, Artificial
  Synthetic oligonucleotide
tgatgatgaagcccctgatgctgaaaccactgctgctgcaaccactgcgaccactgctgctcctaccactgcaaccaccgctgcttctaccactgctcgtaaagacattccagccccttgacaata

SEQ ID NO: 882 - DNA, 25 bp, Artificial
  Synthetic oligonucleotide
tccagcaataaccatttttcacttc

SEQ ID NO: 883 - DNA, 26 bp, Artificial
  Synthetic oligonucleotide
gctttcacagacttttgcttaggatt

SEQ ID NO: 884 - DNA, 102 bp, Artificial
  Synthetic oligonucleotide
tccagcaataaccatttttcacttccagcctcatgtcaaacagccagtttccatgtggatagtctttgttataaggaatcctaagcaaaagtctgtgaaagc

SEQ ID NO: 885 - protein, 112 aa, Homo sapiens; identical to SEQ ID NO: 588

SEQ ID NO: 886 - protein, 141 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 887 - protein, 165 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLASSRHTAELKEMPPPPALFFQPSPPTPHLPE

SEQ ID NO: 888 - protein, 164 aa, Homo sapiens [sequence omitted]

SEQ ID NO: 889 - DNA, 26 bp, Homo sapiens
acactaaaagaacaaacaccttgctc

SEQ ID NO: 890 - DNA, 22 bp, Homo sapiens
tcctcagaaggcacatgaaaga

SEQ ID NO: 891 - DNA, 106 bp, Artificial
  Synthetic oligonucleotide
acactaaaagaacaaacaccttgctcttcgagatgagacattttgccaagcagttgaccacttagttctcaagaagcaactatctctttcatgtgccttctgagga

SEQ ID NO: 892 - DNA, 20 bp, Homo sapiens
agtgatggagcaaagtgccg

SEQ ID NO: 893 - DNA, 21 bp, Homo sapiens
cagcagctgatgcaaactgag

SEQ ID NO: 894 - DNA, 132 bp, Artificial
  Synthetic oligonucleotide
agtgatggagcaaagtgccgggatcatgtaccgcaagtcctgtgcatcatcagcggcctgtctcatcgcctctgccgggtaccagtccttctgctccccagggaaactgaactcagtttgcatcagctgctg

SEQ ID NO: 895 - DNA, 50 bp, Homo sapiens
agttcatccttcttcagtgtgaccagtaaattcttcccatactcttgaag

SEQ ID NO: 896 - DNA, 50 bp, Homo sapiens
gctgatatggaagttggggaatctgaattgccagagaatcttgggaagag

SEQ ID NO: 897 - DNA, 50 bp, Homo sapiens
tctcatagaagcaaaggagaacagaaaccaccagccacctcaacccaagg

SEQ ID NO: 898 - DNA, 50 bp, Homo sapiens
tgaagagtgtgaggaaaacctatgtttgccgcttaagctttcagctcagc

SEQ ID NO: 899 - DNA, 50 bp, Homo sapiens
gacatctttgcatatcatgtcagagctataacatcattgtggagaagctc

SEQ ID NO: 900 - DNA, 50 bp, Homo sapiens
gtcatgaaaatcaacaccgaggtgcggagcttcggacctgtgtcccgcag

SEQ ID NO: 901 - DNA, 50 bp, Homo sapiens
atgagagtaacctcacccgtgcactagtttacagagcattcactgcccca

SEQ ID NO: 902 - DNA, 50 bp, Homo sapiens
cagagatgagagcctggagcattgcagatgccagggacttcacaaatgaa

SEQ ID NO: 903 - DNA, 50 bp, Homo sapiens
gctgcaatctaagtttcggaatacttataccactccagaaataatcctcg

SEQ ID NO: 904 - DNA, 50 bp, Homo sapiens
ttcagaactgttaacatcgctgacgggaagtggcatcgggtagcaatcag

SEQ ID NO: 905 - DNA, 50 bp, Homo sapiens
ccgcgttgcttctagaggctgaatgcctttcaaatggagaaggcttccat

SEQ ID NO: 906 - DNA, 50 bp, Homo sapiens
ctcaaaatgaaactccctctcgcagagcacaattccaattcgctctaaaa

SEQ ID NO: 907 - DNA, 50 bp, Homo sapiens
aaggaccagagtccatgccaagaccacccttcagcttccaaggccctcca

SEQ ID NO: 908 - DNA, 50 bp, Homo sapiens
atcctccagccatgaggctgctctgggggctgatctgggcatccagcttc

SEQ ID NO: 909 - DNA, 50 bp, Homo sapiens
cctgtttgctctgacaccaacttcctaccctctcagcctcaaagtaactc

SEQ ID NO: 910 - DNA, 50 bp, Homo sapiens
gctgaggtgtggccgaggacctgaccatctggaagtgtgaaaatcccctt

SEQ ID NO: 911 - DNA, 50 bp, Homo sapiens
acaagatccccgtgaagtacctggagttcatctcggaatgcatcatccag

SEQ ID NO: 912 - DNA, 50 bp, Homo sapiens
taaacaatcaaagagcatgttggcctggtcctttgctaggtactgtagag

SEQ ID NO: 913 - DNA, 50 bp, Homo sapiens
tgcctcgccacaatggcacctgccctaaaatagcttcccatgtgagggct

SEQ ID NO: 914 - DNA, 50 bp, Homo sapiens
gagaagatgaacccgctggaacagtatgagcgaaaggtgaatgcgtctgt

SEQ ID NO: 915 - DNA, 50 bp, Homo sapiens
aaaaggagacttcggctacccagagaagttcagtgcccagctctactgag

SEQ ID NO: 916 - DNA, 50 bp, Homo sapiens
aaaggctggcatagggggaggtttcccaggtagaagaagaagtgtcagca

SEQ ID NO: 917 - DNA, 50 bp, Homo sapiens
aattaaccctttgagagctggccaggactctggactgattaccccagcct

SEQ ID NO: 918 - DNA, 2650 bp, Homo sapiens
agggacagcccagaggaggcgtggccacgctgccggcggaagtggagccctccgcgagcgcgcgaggccgccggggcaggcggggaaaccggacagtaggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtaacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatggatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagccaaaaaaaaaaaaaaaaaaaa

SEQ ID NO: 919 - DNA, 20 bp, Artificial
  Synthetic oligonucleotide
gaggccgtcaccaagaacat

SEQ ID NO: 920 - DNA, 19 bp, Artificial
  Synthetic oligonucleotide
ggacagccggtcagagctc

SEQ ID NO: 921 - DNA, 111 bp, Artificial
  Synthetic oligonucleotide
gaggccgtcaccaagaacattcacgagtcctgcatgagccagataggctggaaccgcatcatcgtggagaagcccttcgggagggacctgcagagctctgaccggctgtcc

SEQ ID NO: 922 - DNA, 2277 bp, Homo sapiens
gactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcgcagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggacggtctctgcgatatgataccagctattttgtggagtattttgccttggatctcctgatggagaacggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtcgatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacagacctggtggagaccctggagctgcagaacctgatgctgtgtgcgctgcagaccatctacggagcagaggcgcggaaggagtcacggggcgcgcatgccagggaagactacaaggtgcggattgatgagtacgattactccaagcccatccaggggcaacagaagaagccctttgaggagcactggaggaagcacaccctgtcctttgtggacgttggcactgggaaggtcactctggaatatagacccgtaatcgacaaaactttgaacgaggctgactgtgccaccatcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgag

SEQ ID NO: 923 - DNA, 20 bp, Artificial
  Synthetic oligonucleotide
tgggaacaagagggcatctg

SEQ ID NO: 924 - DNA, 22 bp, Artificial
  Synthetic oligonucleotide
ccaccactgcatcaaattcatg

SEQ ID NO: 925 - DNA, 86 bp, Artificial
  Synthetic oligonucleotide
tgggaacaagagggcatctgctaaagtttcagattccatttctgctcagtatccagtagtggatcatgaatttgatgcagtggtgg

SEQ ID NO: 926 - DNA, 1536 bp, Homo sapiens
gtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtaaaaaaaaaaaaaaaaaaaaaaaaaaaaaaaaaaa

SEQ ID NO: 927 - DNA, 19 bp, Artificial
  Synthetic oligonucleotide
tgagagtgattcgcgtggg

SEQ ID NO: 928 - DNA, 21 bp, Artificial
  Synthetic oligonucleotide
ccagggtacgaggctttcaat

SEQ ID NO: 929 - DNA, 91 bp, Artificial
  Synthetic oligonucleotide
tgagagtgattcgcgtgggtacccgcaagagccagcttgctcgcatacagacggacagtgtggtggcaacattgaaagcctcgtaccctgg

SEQ ID NO: 930 - DNA, 1331 bp, Homo sapiens
tcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaattt

SEQ ID NO: 931 - DNA, 21 bp, Artificial
  Synthetic oligonucleotide
tgacactggcaaaacaatgca

SEQ ID NO: 932 - DNA, 21 bp, Artificial
  Synthetic oligonucleotide
ggtccttttcaccagcaagct

SEQ ID NO: 933 - DNA, 94 bp, Artificial
  Synthetic oligonucleotide
tgacactggcaaaacaatgcagactttgctttccttggtcaggcagtataatccaaagatggtcaaggtcgcaagcttgctggtgaaaaggacc

SEQ ID NO: 934 - DNA, 748 bp, Homo sapiens
gcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgcaaaaaaaaaaaaaaaa

SEQ ID NO: 935 - DNA, 23 bp, Artificial
  Synthetic oligonucleotide
tggcaagaagaaggtctggttag

SEQ ID NO: 936 - DNA, 22 bp, Artificial
  Synthetic oligonucleotide
tgatcagcccatctttgatgag

SEQ ID NO: 937 - DNA, 101 bp, Artificial
  Synthetic oligonucleotide
tggcaagaagaaggtctggttagaccccaatgagaccaatgaaatcgccaatgccaactcccgtcagcagatccggaagctcatcaaagatgggctgatca

SEQ ID NO: 938 - DNA, 1867 bp, Homo sapiens
ggttcgctgtggcgggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttaaaaaaaaaaaaaaaaaaaaaa

SEQ ID NO: 939 - DNA, 20 bp, Artificial
  Synthetic oligonucleotide
cggtttgctgcggtaatcat

SEQ ID NO: 940 - DNA, 21 bp, Artificial
  Synthetic oligonucleotide
tttcttgctgccagtctggac

SEQ ID NO: 941 - DNA, 122 bp, Artificial
  Synthetic oligonucleotide
cggtttgctgcggtaatcatgaggataagagagccacgaaccacggcactgattttcagttctgggaaaatggtgtgcacaggagccaagagtgaagaacagtccagactggcagcaagaaa

SEQ ID NO: 942 - DNA, 2201 bp, Homo sapiens
cgggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgatcagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaaaaaaaaaaaaaaaaaaaaaaaa

SEQ ID NO: 943 - DNA, 19 bp, Artificial
  Synthetic oligonucleotide
atttgggtcgcggttcttg

SEQ ID NO: 944 - DNA, 21 bp, Artificial
  Synthetic oligonucleotide
tgccttgacattctcgatggt

SEQ ID NO: 945 - DNA, 133 bp, Artificial
  Synthetic oligonucleotide
atttgggtcgcggttcttgtttgtggatcgctgtgatcgtcacttgacaatgcagatcttcgtgaagactctgactggtaagaccatcaccctcgaggttgagcccagtgacaccatcgagaatgtcaaggca

SEQ ID NO: 946 - protein, 40 aa, Artificial
  Synthetic peptide
EEEVSADQVSVGASGVLGSFKEARNAPSFLSWSFSMGPSK

SEQ ID NO: 947 - protein, 11 aa, Artificial
  Synthetic peptide
ICHIWKLIFLP

SEQ ID NO: 948 - protein, 5 aa, Artificial
  Synthetic peptide
LMDQK

SEQ ID NO: 949 - protein, 5 aa, Artificial
  Synthetic peptide
SQDLH

SEQ ID NO: 950 - protein, 44 aa, Artificial
  Synthetic peptide
FGSGLVPMSPTSLLLLARLYFTWDMLLCWDSCMSTGLSSTCSRP

SEQ ID NO: 951 - protein, 33 aa, Artificial
  Synthetic peptide
GQVRWLTPVIPALWEAKAGGSPEVRSSILAWPT

SEQ ID NO: 952 - protein, 47 aa, Artificial
  Synthetic peptide
GCWPSRQSREQHISSRRKMEILKTECQEKESRTIHSMRRKMEKKNFI

SEQ ID NO: 953 - protein, 15 aa, Artificial
  Synthetic peptide
MDPDWCQCLQLHFCS

SEQ ID NO: 954 - protein, 15 aa, Artificial
  Synthetic peptide
NSPGSADSIPPVPAG

SEQ ID NO: 955 - protein, 15 aa, Artificial
  Synthetic peptide
NSPGSADSIPPVPAG

SEQ ID NO: 956 - protein, 55 aa, Artificial
  Synthetic peptide
MGLSDGEWQLVLNVWGKVEADIPGHGQEVLIRLFKGHPETLEKFDKFKHLKSEDE

SEQ ID NO: 957 - protein, 55 aa, Artificial; identical to SEQ ID NO: 956
  Synthetic peptide

SEQ ID NO: 958 - protein, 15 aa, Artificial
  Synthetic peptide
ECLTVNPSLQIPLNP

SEQ ID NO: 959 - protein, 18 aa, Artificial
  Synthetic peptide
ECVCSKGFPFPLIGDSEG

SEQ ID NO: 960 - protein, 49 aa, Artificial
  Synthetic peptide
VRGGTAGYLGEETRGQRPGCDSQSHTGPSKKPSAPSPLPAGTSWDRGVP

SEQ ID NO: 961 - protein, 17 aa, Artificial
  Synthetic peptide
RECLLPWLPLQISEGRS

SEQ ID NO: 962 - protein, 139 aa, Artificial
  Synthetic peptide
LTSFQLPNAPLFLRRPRLRLFSCPLDPLSVSWTPSYPLNTASLPLPSLSAQLPDPETWTLTCCVFDPCFLALGFLLPPPSILCSVPWIFTAFPRIVFFFFFFLRQVLALSPRQESSVRSWLIATSTSWVQAILLPQPLE

SEQ ID NO: 963 - protein, 57 aa, Artificial
  Synthetic peptide
PQNPNSQPRAAGSLEVIISHPFVRRLEILISPFQFQNSIPKNSQIVPAASPRGTSSP

SEQ ID NO: 964 - protein, 20 aa, Artificial
  Synthetic peptide
VPIGWVLSPSPTSLRAPLPG

SEQ ID NO: 965 - protein, 31 aa, Artificial
  Synthetic peptide
ERQDLTMLSRLVLNSWPQMILPPQPPKVLEL

SEQ ID NO: 966 - protein, 51 aa, Artificial
  Synthetic peptide
ALGVRQLVGGGHSSRFSHLVVAGLPHACHRKSGSSSQVLCPEPSALLSVAG

SEQ ID NO: 967 - protein, 24 aa, Artificial
  Synthetic peptide
ELGFPSSTGRDESLEHCRCQGLHK

SEQ ID NO: 968 - protein, 11 aa, Artificial
  Synthetic peptide
TTGVSTPAPGV

SEQ ID NO: 969 - protein, 15 aa, Artificial
  Synthetic peptide
VRPCLPVPLLLCWPL

SEQ ID NO: 970 - protein, 11 aa, Artificial
  Synthetic peptide
TTGVSTPAPGV

SEQ ID NO: 971 - protein, 31 aa, Artificial
  Synthetic peptide
GETVLLWVMQNPEPMPVKFSLAKYLGHNEHY

SEQ ID NO: 972 - protein, 25 aa, Artificial
  Synthetic peptide
VSMMIINSQTIMVVNYSSSFITLML

SEQ ID NO: 973 - protein, 15 aa, Artificial
  Synthetic peptide
MCCNLSFGILIPLQK

SEQ ID NO: 974 - protein, 42 aa, Artificial
  Synthetic peptide
VSFSFSLFYKKVIKFACDKRFVGRHDERKVVKLSLPLYLIYE

SEQ ID NO: 975 - protein, 13 aa, Artificial
  Synthetic peptide
VRSTRPEKVFVFQ

SEQ ID NO: 976 - protein, 18 aa, Artificial
  Synthetic peptide
CYKIEITMPKRRKVKLRD

SEQ ID NO: 977 - protein, 22 aa, Artificial
  Synthetic peptide
RPHRSLSIQELGEPGPSEGWGG

SEQ ID NO: 978 - protein, 25 aa, Artificial
  Synthetic peptide
DVTLSGPQVTLLPFPCTPAPCSLCS

SEQ ID NO: 979 - protein, 32 aa, Artificial
  Synthetic peptide
SGCKGKQEGGQERTVTGRWTAQEATEGKKGGP

SEQ ID NO: 980 - protein, 17 aa, Artificial
  Synthetic peptide
RAREGVGPGTGGGEGVE

SEQ ID NO: 981 - protein, 56 aa, Artificial [sequence omitted]

SEQ ID NO: 982 - protein, 26 aa, Artificial
  Synthetic peptide
AERQGGAVWHGHRGRHPPEWIPRPAC

SEQ ID NO: 983 - protein, 46 aa, Artificial
  Synthetic peptide
VGAVPGLWRGWVVLRPRACLSPGSTSLGHGDCPGCPVCLLDCLPHH

SEQ ID NO: 984 - protein, 4 aa, Artificial
  Synthetic peptide
SGER

SEQ ID NO: 985 - protein, 17 aa, Artificial
  Synthetic peptide
SMKQTGEAGRAGGRQGG

SEQ ID NO: 986 - protein, 59 aa, Artificial
  Synthetic peptide
QSSHRGPGLTLPRGPAVLVSLGVACSSYRSCTQPVCSDTNFLPSQPQSNSPFPLLLTPS

SEQ ID NO: 987 - protein, 51 aa, Artificial
  Synthetic peptide
SADVLCFTGHQVRADSWPPCVLLKSASVLRGSALASVAPWSGVCRTRMATG

SEQ ID NO: 988 - protein, 64 aa, Artificial
  Synthetic peptide
ETEGLGRGSGGGMAGAPPTLSDGFPNFREVPSPASRPGAGSAGRGWLQDEVCLLLPPCGVRLPG

SEQ ID NO: 989 - protein, 98 aa, Artificial
  Synthetic peptide
ETEGLGRGSGGGMAGAPPTLSDGFPNFREVPSPASRPGAGSAGRGWLQDEVCLLLPPCGVRSVFPPRPWPDPPSGTGCFGLSGCSLLLLQVMHAACLL

SEQ ID NO: 990 - protein, 21 aa, Artificial
  Synthetic peptide
RNPVRLLQPRAQMFCVLRGTK

SEQ ID NO: 991 - protein, 25 aa, Artificial
  Synthetic peptide
DVTLSGPQVTLLPFPCTPAPCSLCS

SEQ ID NO: 992 - protein, 7 aa, Artificial
  Synthetic peptide
VSSRGEG

SEQ ID NO: 993 - protein, 27 aa, Artificial
  Synthetic peptide
AGEWTEPHFPLKGRVPGRPGEAEYGHY

SEQ ID NO: 994 - protein, 4 aa, Artificial
  Synthetic peptide
SGER

SEQ ID NO: 995 - protein, 14 aa, Artificial
  Synthetic peptide
VWSATQGNPLCPRY

SEQ ID NO: 996 - protein, 14 aa, Artificial
  Synthetic peptide
WKVHLPKGEGFSSG

SEQ ID NO: 997 - protein, 6 aa, Artificial
  Synthetic peptide
VFLNFS

SEQ ID NO: 998 - protein, 8 aa, Artificial
  Synthetic peptide
VSIFYVFI

SEQ ID NO: 999 - protein, 5 aa, Artificial
  Synthetic peptide
DWTRP

SEQ ID NO: 1000 - protein, 22 aa, Artificial
  Synthetic peptide
LLLSSQLWPPSASRLECWPGWL

SEQ ID NO: 1001 - protein, 70 aa, Artificial
  Synthetic peptide
KWIHEALASHFQVESGSQRRARKKFSFPTCVQGAHANPKFSPEPSQFTSADSFPLVFLFFVVFCFLISHV

SEQ ID NO: 1002 - protein, 42 aa, Artificial
  Synthetic peptide
REYFHMTSGCWGSVLLPTYGIVRPGLCLWPSLHYILYQGLDI

SEQ ID NO: 1003 - protein, 7 aa, Artificial
  Synthetic peptide
TQGVVGD

SEQ ID NO: 1004 - protein, 15 aa, Artificial
  Synthetic peptide
VPGAVGQGRKHLGRV

SEQ ID NO: 1005 - protein, 29 aa, Artificial
  Synthetic peptide
PHKYSAHGRTRHFESATRTTNGAQKLSRI

SEQ ID NO: 1006 - protein, 751 aa, Artificial
  Synthetic peptide
MKYSCCALVLAVLGTELLGSLCSTVRSPRFRGRIQQERKNIRPNIILVLTDDQDVELAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLME

SEQ ID NO: 1007 - protein, 13 aa, Artificial
  Synthetic peptide
CVIVPPLSQPQIH

SEQ ID NO: 1008 - protein, 22 aa, Artificial
  Synthetic peptide
ARYDGDQPRCAPRPRGLSPTVF

SEQ ID NO: 1009 - protein, 8 aa, Artificial
  Synthetic peptide
GLLHRLNH

SEQ ID NO: 1010 - protein, 145 aa, Artificial
  Synthetic peptide
VGTATGRAGWREQAPCRGTRLLLSPQTSQGKTRAPRGRCPCRVPGKTLFSSRRCGHTPSVPFRFRIPHLRGAAASTRLVPPKGSMSAYCVLLGQELGSPFVAQGTSSAAGQGPPACILAATLDAFIPARAGLACLWDLLGRCPRG

SEQ ID NO: 1011 - protein, 26 aa, Artificial
  Synthetic peptide
VRIFLALSLTLIVPWSQGWTRQRDQR

SEQ ID NO: 1012 - protein, 90 aa, Artificial
  Synthetic peptide
MTLSPLLLFLPPLLLLLDVPTAAVQASPLQALDFFGNGPPVNYKTGNLYLRGPLKKSNAPLVNVTLYYEALCGGCRAFLIRELFPTWLLV

SEQ ID NO: 1013 - protein, 41 aa, Artificial
  Synthetic peptide
NPWKIRPSSLPLSASCTRARSRMSALPQPAPSGVFASSDGR

SEQ ID NO: 1014 - protein, 90 aa, Artificial; identical to SEQ ID NO: 1012
  Synthetic peptide

SEQ ID NO: 1015 - protein, 90 aa, Artificial; identical to SEQ ID NO: 1012
  Synthetic peptide

SEQ ID NO: 1016 - protein, 38 aa, Artificial
  Synthetic peptide
KPLEDQTQLLTLVCQLYQGKKPDVCPSSTSSLRSVCFK

SEQ ID NO: 1017 - protein, 15 aa, Artificial
  Synthetic peptide
DSLLQVLNVKEGTPS

SEQ ID NO: 1018 - protein, 6 aa, Artificial
  Synthetic peptide
GHCGLE

SEQ ID NO: 1019 - protein, 23 aa, Artificial
  Synthetic peptide
GMYVISFHQIYKISRNQHSCFYF

SEQ ID NO: 1020 - protein, 28 aa, Artificial
  Synthetic peptide
YAPPLLTFLPTRPSCGSQDGKGPPHQVI

SEQ ID NO: 1021 - protein, 38 aa, Artificial
  Synthetic peptide
WAPGAALGQGREGRTQAGAGLLEPAQAEPGRQLTRLHR

SEQ ID NO: 1022 - protein, 110 aa, Artificial
  Synthetic peptide
MWVLGIAATFCGLFLLPGFALQIQCYQCEEFQLNNDCSSPEFIVNCTVNVQDMCQKEVMEQSAGIMYRKSCASSAACLIASAGSPCRGLAPGREEQRALHKAGAVGGGVR

SEQ ID NO: 1023 - protein, 139 aa, Artificial
  Synthetic peptide
SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 1024 - protein, 29 aa, Artificial
  Synthetic peptide
SHCVTRLECSGTISAHCNLCLPGSNDHPT

SEQ ID NO: 1025 - protein, 5 aa, Artificial
  Synthetic peptide
MWVLG

SEQ ID NO: 1026 - protein, 21 aa, Artificial
  Synthetic peptide
DTKRTNTLLFEMRHFAKQLTT

SEQ ID NO: 1027 - protein, 27 aa, Artificial
  Synthetic peptide
DRVSLCHEAGVQWNNFSTLQPLPPRLK

SEQ ID NO: 1028 - protein, 5 aa, Artificial
  Synthetic peptide
MWVLG

We claim:

1. An isolated polynucleotide consisting of the sequence of SEQ ID NO:193.
2. An isolated polynucleotide consisting of the sequence of SEQ ID NO:194.
3. An isolated amplicon consisting of the sequence of SEQ ID NO:861.
4. A primer pair, comprising a pair of isolated oligonucleotides to amplify said amplicon of claim 3, said pair of isolated oligonucleotides consisting of the sequences of SEQ ID NOs. 859 and 860.
5. An isolated polynucleotide comprising the polynucleotide sequence set forth in SEQ ID NO:193 or degenerate variants thereof encoding the polypeptide set forth in SEQ ID NO:207.

* * * * *